(12) United States Patent
Reh et al.

(10) Patent No.: US 6,750,196 B1
(45) Date of Patent: *Jun. 15, 2004

(54) METHODS OF TREATING DISORDERS OF THE EYE

(75) Inventors: Thomas A. Reh, Seattle, WA (US); Mark A. Marchionni, Arlington, MA (US); Kathryn L. McCabe, Seattle, WA (US); Olivia Bermingham-McDonogh, Watertown, MA (US); Nagesh K. Mahanthappa, Cambridge, MA (US); David I. Gwynne, Beverly, MA (US)

(73) Assignee: Acorda Therapeutics, Hawthorne, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 08/411,295

(22) Filed: Mar. 27, 1995

(51) Int. Cl.[7] .................................................. A61K 38/18
(52) U.S. Cl. ............................. 514/2; 514/12; 514/912; 514/913; 514/914
(58) Field of Search ....................... 514/2, 12

(56) References Cited

FOREIGN PATENT DOCUMENTS

| WO | WO 94/03644 | 2/1974 |
|----|-------------|--------|
| WO | WO 91/02003 | 2/1991 |
| WO | WO 93/15608 | 8/1993 |
| WO | WO 94/00140 | 1/1994 |
| WO | WO 96/15812 | 5/1996 |

OTHER PUBLICATIONS

Rudinger. In *Peptide Hormones*, ed. J. A. Parsons, University Pard Press, Baltimore, pp. 1–7, 1976.*
Bermingham, McDonogh et al.(1966) *Development* vol. 122, pp. 1427–1438.
Bermingham–MacDonogh et al. (1995) *Society for Neuro-Science Abstracts* vol. 21, Nos. 1–3, p. 547.
Carraway et al. (1995) *Current Opinion in Neurobiology* vol. 5, pp. 606–612.
Lee et al. (1995) *Nature* vol. 378, pp. 394–398.
Levine et al. (1995) *Society for NeuroScience Abstracts* vol. 21, Nos. 1–3 p. 1767.

* cited by examiner

*Primary Examiner*—Gary Kunz
*Assistant Examiner*—Stephen Gucker

(57) ABSTRACT

In general, the present invention provides methods for promoting the function of retinal cells using neuregulins. A novel aspect of the invention involves the use of neuregulins as growth factors tp promote survival of retinal cells. Treating of the retinal cells to provide these effects may be achieved by contacting retinal cells with a polypeptide described herein. The treatments may be provided to slow or halt net cell loss or to increase the amount or quality of retinal tissue present in the vertebrate.

21 Claims, 54 Drawing Sheets

Figure 11A

```
CCTGCAG CAT CAA GTG TGG GCG AAA GCC GGG GGC TTG AAG AAG GAC TCG CTG    55
        His Gln Val Trp Ala Lys Ala Gly Gly Leu Lys Lys Asp Ser Leu

CTC ACC GTG CGC CTG GGC GCC TGG CAC CCC GCC TTC CCC TCC TGC           103
Leu Thr Val Arg Leu Gly Ala Trp His Pro Ala Phe Pro Ser Cys

GGG CGC CTC AAG GAG GAC GAC AGC AGG TAC ATC TTC TTC ATG GAG CCC GAG   151
Gly Arg Leu Lys Glu Asp Asp Ser Arg Tyr Ile Phe Phe Met Glu Pro Glu

GCC AAC AGC AGC GGC GGG CCC CGC CTT CCG AGC CTC CTT CCC CCC           199
Ala Asn Ser Ser Gly Gly Pro Arg Leu Pro Ser Leu Leu Pro Pro

TCT CGA GAC GGG CCG GAA CCT CAA GGT CAG CCG GGT GCT GTG               247
Ser Arg Asp Gly Pro Glu Pro Gln Gly Gln Pro Gly Ala Val

CAA CGG TGC GCC TTG CCT CCC CGC TTG AAA GAG ATG AAG AGT CAG GAG       295
Gln Arg Cys Ala Leu Pro Pro Arg Leu Lys Glu Met Lys Ser Gln Glu

TCT GTG GCA GGT TCC AAA CTA GTG CTT CGG TGC GAG ACC AGT TCT GAA       343
Ser Val Ala Gly Ser Lys Leu Val Leu Arg Cys Glu Thr Ser Ser Glu

TAC TCC TCT CTC AAG TTC AAG TGG TTC AAT GGG AGT GAA TTA AGC           391
Tyr Ser Ser Leu Lys Phe Lys Trp Phe Asn Gly Ser Glu Leu Ser

CGA AAC CCA GAA AAC ATC AGC ATA CAG ATT AGG CCG GGG AAG               439
Arg Asn Pro Glu Asn Ile Ser Ile Gln Ile Arg Pro Gly Lys

TCA GAA CTT CGC ATT AGC AGC GCG TCA CTG GCT GAT TCT GGA GAA TAT       487
Ser Glu Leu Arg Ile Ser Ser Ala Ser Leu Ala Asp Ser Gly Glu Tyr

ATG TGC AAA GTG ATC GTG GAG CTA GGA AAT GAC AGT GCC TCT GCC AAC       535
Met Cys Lys Val Ile Val Glu Leu Gly Asn Asp Ser Ala Ser Ala Asn

ATC ACC ATT GTG GAG TCA AAC AAC GGT AAG GGT TGC CTA CTG CGT GCT ATT   583
Ile Thr Ile Val Glu Ser Asn Asn Gly Lys Gly Cys Leu Leu Arg Ala Ile

TCT CAG TCT CTA AGA GGA GTG ATC AAG GTA TGT GGT CAC ACT               625
Ser Gln Ser Leu Arg Gly Val Ile Lys Val Cys Gly His Thr

TGAATCACGC AGGTGTGTGA AATTCATTG TGAACAAATA AAAATCATGA AAGGAAAAAA      685

AAAAAAAAAA AATCGATGTC GACTCGAGAT GTGGCTGCAG GAGGATCCC               744
```

Figure 11B

Nucleotide Sequences & Deduced Amino Acid Sequences of GGF2BPP2

```
CCTGCAG CAT CAA GTG TGG GCG GCG AAA GCC GGG GGC TTG AAG AAG GAC TCG CTG  55
        His Gln Val Trp Ala Ala Lys Ala Gly Gly Leu Lys Lys Asp Ser Leu

CTC ACC GTG CGC CTG GCC GCC TGG GGC CAC CCC GCC TTC CCC TCC TGC          103
Leu Thr Val Arg Leu Gly Ala Trp Gly His Pro Ala Phe Pro Ser Cys

GGG CGC CTC AAG GAG GAC AGC AGG AGG TAC ATC TTC TTC ATG GAG CCC GAG      151
Gly Arg Leu Lys Glu Asp Ser Arg Arg Tyr Ile Phe Phe Met Glu Pro Glu

GCC AAC AGC AGC GGC GGG GGC CCC CGC CTT CCG AGC CTC CTT CCC CCC          199
Ala Lys Ser Ser Gly Gly Gly Pro Arg Leu Pro Ser Leu Leu Pro Pro

TCT CGA GAC GGG CCG GAA CCT CAA GAA GGT GGA CAG CCG GGT GCT GTG          247
Ser Arg Asp Gly Pro Glu Pro Gln Glu Gly Gly Gln Pro Gly Ala Val

CAA CGG TGC GCC TTG CCT CCC CCG CGC TTG AAA GAG ATG AAG CCG GAG GAG      295
Gln Arg Cys Ala Leu Pro Pro Pro Arg Leu Lys Glu Met Lys Ser Gln Glu

TCT GTG GCA GGT TCC AAA CTA GTG CTT CGG TGC GAG ACC AGT TCT GAA          343
Ser Val Ala Gly Ser Lys Leu Val Leu Arg Cys Glu Thr Ser Ser Glu

TAC TCC TCT CTC AAG TTC TGG TTC AAG ATA GGG AGT GAA TTA AGC              391
Tyr Ser Ser Leu Lys Phe Trp Phe Lys Ile Asn Gly Ser Glu Leu Ser

CGA AAG AAC CCA GAA AAC ATC AAG CAG CAG AGG CCG GGG AAG                  439
Arg Lys Asn Lys Gly Gly Asn Ile Ile Lys Gln Gln Lys Arg Pro Gly Lys

TCA GAA CTT AGC ATT CGC AAA GCG TCA CTG GCT GAT TCT GGA GAA TAT          487
Ser Glu Leu Ser Ile Arg Lys Ala Ser Leu Ala Asp Ser Gly Glu Tyr

ATG TGC AAA GTG ATC ATC AGC AAA CTA GGA AAT GAC AGT GCC TCT GCC AAC      535
Met Cys Lys Val Ile Ser Lys Leu Gly Asn Asp Ser Ala Ser Ala Asn
```

Figure 11B'
Nucleotide Sequences & Deduced Amino Acid Sequences of GG2BPP2

```
ATC ACC ATT GTG GAG TCA AAC GCC ACA TCC ACA GCT GGG ACA                        583
Ile Thr Ile Val Glu Ser Asn Ala Thr Ser Thr Ala Gly Thr

AGC CAT CTT GTC AAG TGT GCA GAG AAG GAG AAA ACT TTC TGT GTG AAT                631
Ser His Leu Val Lys Ser Ala Glu Lys Glu Lys Thr Phe Cys Val Asn

GGA GGC GAG TGC TTC ATG GTG AAA GAC CTT TCA AAT CCC TCA AGA TAC                679
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT                727
Leu Cys Lys Cys Gln Pro Gly Phe Thr Gly Ala Arg Cys Thr Glu Asn

GTG CCC ATG AAA GTC CAA ACC CAA GAA AGT GCC CAA ATG AGT TTA CTG                775
Val Pro Met Lys Val Gln Thr Gln Glu Ser Ala Gln Met Ser Leu Leu

GTG ATC GCT GCC AAA ACT ACG TAATGGCCAG CTTCTACAGT ACGTCCACTC                   826
Val Ile Ala Ala Lys Thr Thr

CCTTTCTGTC TCTGCCTGAA TAGCGCATCT CAGTCGGTGC CGCTTTCTTG TTGCCGCATC              886

TCCCCTCAGA TTCCTCCTAG AGCTAGATGC GTTTTACCAG GTCTAACATT GACTGCCTCT              946

GCCTGTCGCA TGAGAACATT AACACAAGCG ATTGTATGAC TTCCCTCGTC CGTGACTAGT              1006

GGGCTCTGAG CTACTCGTAG GTGCGTAAGG CTCCAGTGTT TCTGAAATTG ATCTTGAATT              1066

ACTGTGATAC GACATGATAG TCCCTCTCAC CCAGTGCAAT GACAATAAAG GCCTTGAAAA              1126

GTCAAAAAAA AAAAAAAAAA AAAAAATCGA TGTCGACTCG AGATGTGGCT GCAGGTCGAC              1186

TCTAGAG                                                                        1193
```

Figure 11C

Nucleotide Sequences & Deduced Amino Acid Sequences of GGF2BPP3

```
CCTGCAG CAT CAA GTG TGG GCG GCG AAA GCC GGG GGC TTG AAG GAC TCG CTG   55
        His Gln Val Trp Ala Ala Lys Ala Gly Gly Leu Lys Asp Ser Leu

CTC ACC GTG CGC CTG GGC GCC TGG GGC CAC CCC GCC TTC CCC AAG GAC TGC  103
Leu Thr Val Arg Leu Gly Ala Trp Gly His Pro Ala Phe Pro Lys Asp Cys

GGG CGC CTC AAG GAG GAC AGC AGG TAC ATC TTC TTC ATG GAG CCC GAG      151
Gly Arg Leu Lys Glu Asp Ser Arg Tyr Ile Phe Phe Met Glu Pro Glu

GCC AAC AGC AGC GGG GGG CCC CGC CTT CCG AGC CTC CTT CCC CCC          199
Ala Asn Ser Ser Gly Gly Pro Arg Leu Pro Ser Leu Leu Pro Pro

TCT CGA GAC GGG CCG GAA CCT CAA GAA GGA CAG CCG GGT GCT GTG          247
Ser Arg Asp Gly Pro Glu Pro Gln Glu Gly Gln Pro Gly Ala Val

CAA CGG TGC GCC TTG CCT CCC CGC TTG CTT AAA GAG ATG AAG AGT CAG GAG  295
Gln Arg Cys Ala Leu Pro Pro Arg Leu Lys Glu Met Lys Ser Gln Glu

TCT GTG GCA GGT TCC AAA CTA GTG CTT CGG TGC GAG ACC AGT TCT GAA      343
Ser Val Ala Gly Ser Lys Leu Val Leu Arg Cys Glu Thr Ser Ser Glu

TAC TCC TCT CTC AAG CTC TTC TGG TTC AAG AAT GGG AGT GAA TTA AGC      391
Tyr Ser Ser Leu Lys Leu Phe Trp Phe Lys Asn Gly Ser Glu Leu Ser

CGA AAG AAC CCA AAA GAA AAC ATC AAG ATA CAG ATC AAA AGG CCG GGG AAG  439
Arg Lys Asn Pro Lys Glu Asn Ile Lys Ile Gln Ile Lys Arg Pro Lys

TCA GAA CTT CGC ATT AGC AAA GCG TCA CTG GCT GAT TCT GGA GAA TAT      487
Ser Glu Leu Arg Ile Ser Lys Ala Ser Leu Ala Asp Ser Gly Glu Tyr
```

Figure 11C'
Nucleotide Sequences & Deduced Amino Acid Sequences of GGF2BPP3

```
ATG TGC AAA GTG ATC AGC AAA CTA GGA AAT GAC AGT GCC TCT GCC AAC         535
Met Cys Lys Val Ile Ser Lys Leu Gly Asn Asp Ser Ala Ser Ala Asn

ATC ACC ATT GTG GAG TCA AAC GCC ACA TCC ACA TCT ACA GCT GGG ACA         583
Ile Arg Ile Val Glu Ser Asn Ala Thr Ser Thr Ser Thr Ala Gly Thr

AGC CAT CTT GTC AAG TGT GCA GAG AAG GAG AAA ACT TTC TGT GTG AAT         631
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC         679
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC         727
Leu Cys Lys Cys Pro Asn Glu Phe Thr Gly Asp Arg Cys Gln Asn Tyr

GTA ATG GCC AGC TTC TAC AGT ACG TCC ACT CCC TTT CTG TCT CCT             775
Val Met Ala Ser Phe Tyr Ser Thr Ser Thr Pro Phe Leu Ser Pro

GAA TAGCGCATCT CAGTCGGTGC CGCTTTCTTG TTGCCGCATC TCCCCTCAGA TTCCGCCTAG    838
Glu

AGCTAGATGC GTTTACCAG GTCTAACATT GACTGCCCTCT GCCTGTCGCA TGAGAACATT       898

AACACAAGCG ATTGTATGAC TTCCTCTGTC CGTGACTAGT GGGCTCTGAG CTACTCGTAG       958

GTGCGTAAGG CTCCAGTGTT TCTGAAATTG ATCTTGAATT ACTGTGATAC GACATGATAG      1018

TCCCTCTCAC CCAGTGCAAT GACAATAAAG GCCTTGAAAA GTCAAAAAAA AAAAAAAAA       1078

AAAAATCGAT GTCGACTCGA GATGTGGCTG                                        1108
```

Figure 13A

CODING SEGMENT F:

```
AGTTTCCCCC CCCAACTTGT CGGAACTCTG GGCTCGCGCG CAGGGCAGGA GCGGAGCGGC      60
GGCGGCTGCC CAGGGCGATGC GAGGCGGGC CGGACGGTAA TCGCCTCTCC CTCCTCGGGC    120
TGCGAGGCGC CCGGAGCCAG GCAGCGACAG GAGCCGGACCG CGGCGGGAAC CGAGGACTCC    180
CCAGCGGGCGC GCCAGCAGGA GCCACCCCGC GAGNCGTGCG ACCGGGACGG AGCGCCCCGC   240
AGTCCCAGGT GGCCCCGGACC GCACGTTGCG TCCCCGCGCT CCCCGCCGGC GACAGGAGAC  300
GCTCCCCCCC ACGCGCGCG CGCCTCGGCC CGGTGCGCTGG CCCGCCTCCA CTCCGGGAC    360
                       CGCGAG CGCCTCAGCG CGGCCGCTCG .CCC CTCGAGGGAC
```

```
AAACTTTTCC CGAAGCCGAT CCCAGCCCTC GGACCCAAAC TTGTCGCGCG TCGCCTTCGC     420
|||||||||| |.||.||||| |||||||||  ||||||||                ||||||||
AAACTTTTCC CAAACCCGAT CCGAGCCCTT GGACCAAA..  ............C TCGCCTGCGC   474
```

```
                                             Met Ser Glu Arg  Arg
CGGGAGCCGT CCGCGCAGAG CGTGCACTTC TCGGGCGAG ATG TCG GAG CGC  AGA
|:.||||||| |||||||||| ||||.||||| ||||||||| ||| ||| ||| |||
CGAGAGCCGT CCGCGTAGAG CGCTC.CGTC TCCGGGCGAG ATG TCC GAG CGC  AAA     522
                                                             K
```

```
Gly Ser Gly Glu Gly Lys Gly Lys Lys Gly Lys Lys Asp Arg Gly Ser Gly
GGC TCC GGG GAA GGC AAA GGC AAG AAG GGG AAG AAG GAC CGA GGA TCC GGG
 |||     |||     ||| ||| |||     ||| |||     ||| ||| ||
GGC TCC GGC GAA GGC AGA GGC AAA GGG AAG AAG GAG CGA GGA TCC GGC

Lys Lys Pro Val Pro Ala Ala Gly Gly Pro Ser Pro Ala
AAG AAG CCC GTG CCC GCT GGC CCG AGC CCA G                           559
|||     ||| |||     ||| ||| |||     |||
AAG AAG CCG GAG TCC GCG GGC CAG AGC CCA G
        E    S                R
```

Coding Segments of Glial Growth Factor/Heregulin Gene

Figure 13B

CODING SEGMENT E:

```
CC CAT CAN GTG TGG GCG GCG AAA GCC GGG GGC TTG AAG AAG GAC TCG   47
   His Gln Val Trp Ala Ala Lys Ala Gly Gly Leu Lys Lys Asp Ser

CTG CTC ACC GTG CGC CTG GGC GCC TGG GGC CAC CCC GCC TTC CCC TCC   95
Leu Leu Thr Val Arg Leu Gly Ala Trp Gly His Pro Ala Phe Pro Ser

TGC GGG CGC CTC AAG GAG GAC AGC AGG TAC ATC TTC TTC ATG GAG CCC  143
Cys Gly Arg Leu Lys Glu Asp Ser Arg Tyr Ile Phe Phe Met Glu Pro

GAG GCC AAC AGC AGC GGG GGG CCC GGC CTT CCG AGC CTC CTT CTT CCC  191
Glu Ala Asn Ser Ser Gly Gly Pro Gly Leu Pro Ser Leu Leu Pro

CCC TCT CGA GAC GGG CCG GAA CCT CAA GGA GGT CAG CCG GGT GCT  239
Pro Ser Arg Asp Gly Pro Glu Pro Gln Gly Gly Gln Pro Gly Ala

GTG CAA CGG TGC G                                                252
Val Gln Arg Cys
```

Figure 13C

CODING SEGMENT B:

```
                                                                          48
Leu Pro Pro Arg Leu Lys Glu His Lys Ser Gln Glu Ser Val Ala Gly
CCT TGC CCT CTC GCT TGA AAG AGA TGA AGA GTC AGG AGT CTG TGG CAG
||| ||| --- ||| ||| ||| ||| ||| ||| ||| ||| ||| ||| --- ||| |||
CCT TGC     CTC GAT TGA AAG AGA TGA AAA GCC AGG AAT CGG CTG CAG
         Q                                              A

96
Ser Lys Leu Val Leu Arg Cys Glu Thr Ser Ser Glu Tyr Ser Ser Leu
GTT CCA AAC TAG TGC TTC GGT GCG AGA CCA GTT CTG AAT ACT CCT CTC
||| ||| ||| ||| ||| ||| ||| ||| ||| ||| ||| ||| ||| ||| ||| |||
GTT CCA AAC TAG TCC TTC GGT GTG AAA CCA GTT CTG AAT ACT CCT CTC

144
Lys Phe Lys Trp Phe Lys Asn Gly Ser Glu Leu Ser Arg Lys Asn Lys
TCA AGT TCA AGT GGT TCA AGA ATG GGA GTG AAT TAA GCC GAA AGA ACA
||| --- ||| ||| ||| ||| ||| ||| ||| --- ||| --- ||| ||| ||| |||
TCA GAT TCA AGT GGT TCA AGA ATG GGA ATG AAT TGA ATC GAA AAA ACA
    R                               N           N

178
Pro Gly Asn Ile Lys Ile Gln Lys Arg Pro Gly
AAC CAC AAA ACA ATA TCA AGA TAC AAA GGC CGG G
||| ||| ||| ||| ||| ||| ||| ||| ||| ||| |||
AAC CAC AAA ATA TCA AGA TAC AAA AGC CAG G
                                  K
```

Figure 13D

CODING SEGMENT A:

```
                                                          46
    Lys Ser Glu Leu Arg Ile Ser Lys Ala Ser Leu Ala Asp Ser Gly
  G AAG TCA GAA CTT CGC ATT AGC AAA GCG TCA CTG GCT GAT TCT GGA
    ||| ||| ||| ||| ||| ||| --- ||| ||| ||| ||| ||| ||| ||| |||
  G AAG TCA GAA CTT CGC ATT AAC GCA TCA CTG GCT GAT TCT GGA
                            N

94
    Glu Tyr Met Cys Lys Val Ile Ser Lys Leu Gly Asn Asp Ser Ala Ser
    GAA TAT ATG TGC AAA GTG ATC AGC AAA CTA GGA AAT GAC AGT GCC TCT
    ||| ||| ||| ||| ||| ||| ||| ||| ||| ||| ||| ||| ||| ||| ||| |||
    GAG TAT ATG TGC AAA GTG ATC AGC AAA TTA GGA AAT GAC AGT GCC TCT

122
    Ala Asn Ile Thr Ile Val Glu Ser Asn Ala
    GCC AAC ATC ACC ATT GTG GAG TCA AAC G
    ||| ||| ||| ||| ||| ||| ||| ||| ||| ---
    GCC AAT ATC ACC ATC GTG GAA TCA AAC G
```

Figure 13E
CODING SEGMENT A':

```
TCTAAAACTA CAGAGACTGT ATTTTCATGA TCATCATAGT TCTGTGAAAT ATACTTAAAC    60

CGCTTGGTC CTGATCTTGT AGG AAG TCA GAA CTT CGC ATT AGC AAA GCG       110
                        Lys Ser Glu Leu Arg Ile Ser Lys Ala

TCA CTG GCT GAT TCT GGA GAA TAT ATG TGC AAA GTG ATC AGC AAA CTA    158
Ser Leu Ala Asp Ser Gly Glu Tyr Met Cys Lys Val Ile Ser Lys Leu

GGA AAT GAC AGT GCC TCT GCC AAC ATC ACC ATT GTG GAG TCA AAC GGT    206
Gly Asn Asp Ser Ala Ser Ala Asn Ile Thr Ile Val Glu Ser Asn Gly

AAG AGA TGC CTA CTG CGT GCT ATT TCT CAG TCT CTA AGA GGA GTG ATC    254
Lys Arg Cys Leu Leu Arg Ala Ile Ser Gln Ser Leu Arg Gly Val Ile

AAG GTA TGT GGT CAC ACT TGAATCACGC AGGTGTGTGA AATCTCATTG           302
Lys Val Cys Gly His Thr

TGAACAAATA AAAATCATGA AAGGAAAACT CTATGTTTGA AATATCTTAT GGGTCCTCCT  362

GTAAAGCTCT TCACTCCATA AGGTGAAATA GACCTGAAAT ATATATAGAT TATTT       417
```

Figure 13F
CODING SEGMENT G:

```
     Glu Ile Thr Thr Gly Met Pro Ala Ser Thr Glu Thr Ala Tyr Val Ser
     AG  ATC ACC ACT GGC ATG CCA GCC TCA ACT GAG ACA GCG TAT GTG TCT    47
     ||  ||| ||| ||| ||| ||| ||| ||| ||| ||| ||| | | ||| ||| ||| |||
     AG  ATC ACT GGT ATG CCA GCC TCA ACT GAA GGA GCA TAT GTG TCT
                 I                                  G                A

Ser Glu Ser Pro Ile Arg Ile Ser Val Ser Thr Glu Gly Thr Asn Thr
     TCA GAG TCT CCC ATT AGA ATA TCA GTA TCA ACA GAA GGA ACA AAT ACT    95
     ||| ||| ||| ||| ||| ||| ||| ||| ||| ||| ||| ||| ||| ||| ||| |||
     TCA GAG TCT CCC ATT AGA ATA TCA GTA TCC ACA GAA GGA GCA AAT ACT
                                                                A

Ser Ser Ser
     TCT TCA T                                                         102
     ||| ||| |
     TCT TCA T
```

Figure 13G
CODING SEGMENT C:

```
                                                                                              47
    Thr Ser Thr Ser Thr Ala Gly Thr Ser His Leu Val Lys Cys Ala
 CC ACA TCC ACA TCT ACA GCT GGG ACA AGC CAT CTT GTC AAG TGT GCA
    ||| ||| ||| ||  ||| ||  ||| ||| ||| ||| ||| ||| ||  ||| |||
 CT ACA TCT ACA TCC ACC ACT GGG ACA AGC CAT CTT GTA AAA TGT GCG
                        T-Ser
                                                                                              95
    Glu Lys Glu Lys Thr Phe Cys Val Asn Gly Gly Glu Cys Phe Met Val
    GAG AAG GAG AAA ACT TTC TGT GTG AAT GGA GGC GAG TGC TTC ATG GTG
    ||| ||| ||| ||| ||| ||| ||| ||| ||| ||| ||| ||| ||| ||| ||| |||
    GAG AAG GAG AAA ACT TTC TGT GTG AAT GGA GGG GAG TGC TTC ATG GTG

128
    Lys Asp Leu Ser Asn Pro Ser Arg Tyr Leu Cys
    AAA GAC CTT TCA AAT CCC TCA AGA TAC TTG TGC
    ||| ||| ||| ||| ||  ||| ||| ||| ||| ||| |||
    AAA GAC CTT TCA AAC CCC TCG AGA TAC TTG TGC
```

Figure 13H
CODING SEGMENT C/D:

```
                                                                        48
Lys Cys Gln Pro Gly Phe Thr Gly Ala Arg Cys Thr Glu Asn Val Pro
AAG TGC CAA CCT GGA TTC ACT GGA GCG AGA TGT ACT GAG AAT GTG CCC
 |||  |||  |||  |||  |||  |||  |||  |||  ||   |||  |||  |||  |||  |||  |||  |||
AAG TGC CAA CCT GGA TTC ACT GGA GCA AGA TGT ACT GAG AAT GTG CCC

69
Met Lys Val Gln Thr Gln Glu
ATG AAA GTC CAA ACC CAA GAA
 |||  |||  |||  |||  | |   |||  |||
ATG AAA GTC CAA AAC CAA GAA
              N
```

Figure 13I
CODING SEGMENT D:

```
    Lys Cys Pro Asn Glu Phe Thr Gly Asp Arg Cys Gln Asn Tyr Val Met       48
    AAG TGC CCA AAT GAG TTT ACT GGT GAT CGC TGC CAA AAC TAC GTA ATG
    ||| ||| ||| ||| ||| ||| ||| ||| ||| ||| ||| ||| ||| ||| ||| |||
    AAG TGC CCA AAT GAG TTT ACT GGT GAT CGC TGC CAA AAC TAC GTA ATG

Ala Ser Phe Tyr                                                        60
    GCC AGC TTC TAC
    ||| ||| ||| |||
    GCC AGC TTC TAC
```

Figure 13J
CODING SEGMENT D:

```
    Ser Thr Ser Thr Pro Phe Leu Ser Leu Pro Glu *                          36
    AGT ACG TCC ACT CCC TTT CTG TCT CTG CCT GAA TAG
    ||| ||| ||| ||| ||| ||| ||| ||| ||| ||| ||| |||
    AGT ACG TCC ACT CCC TTT CTG TCT CTG CCT GAA TAG
```

Figure 13K
CODING SEGMENT D'':

```
    Lys His Leu Gly Ile Glu Phe Met Glu                                    27
    AAG CAT CTT GGG ATT GAA TTT ATG GAG
```

Figure 13L
CODING SEGMENT H:

```
Lys Ala Glu Glu Leu Tyr Gln Lys Arg Val Leu Thr Ile Thr Gly Ile
AAA GCG GAG GAG CTC TAC CAG AAG AGA GTG CTC ACC ATT ACC GGC ATT            48
||| ||| ||| ||| ||| ||| ||| ||| ||| ||| ||| ||| ||  ||| ||| ||
AAG GCG GAG GAG CTG TAC CAG AAG AGA GTG CTG ACC ATA ACC GGC ATC

Cys Ile Ala Leu Leu Val Val Gly Ile Met Cys Val Val Tyr Cys
TGC ATC GCG CTG CTC GTT GGC ATC ATG TGT GTG GTC TAC TGC                    96
||| ||| ||| ||| ||| ||| ||  ||| ||| ||| ||| ||  ||| |||
TGC ATC GCC CTC CTT GTG GTC GGC ATC ATG TGT GTG GCC TAC TGC
                         A

Lys Thr Lys Lys Gln Arg Lys Lys Leu His Asp Arg Leu Arg Gln Ser
AAA ACC AAG AAA CAA CGG AAA AAG CTT CAT GAC CTT CGG CAG AGC              144
||| ||| ||| ||| ||| ||| ||| ||| ||| ||| ||| ||| ||| ||| |||
AAA ACC AAG AAA CAG CGG AAA AAG CTG CAT GAC CGT CGG CAG AGC

Leu Arg Ser Glu Arg Asn Thr Met Met Asn Val Ala Asn Gly Pro His
CTT CGG GAA AGA AAC ACC ATG ATG AAC GTA GCC AAC GGG CCC CAC              192
||| ||| ||| ||  ||| ||| ||| ||| ||  ||| ||  ||| ||| ||| |||
CTT CGG GAA TCT AAC ACC ATG ATG AAC GCC ATT GCC AAT GGG CCT CAC
                N                           I

His Pro Asn Pro Pro Glu Asn Val Gln Leu Val Asn Gln Tyr Val
CAC CCC AAT CCG CCC GAG AAC GTG CAG CTG GTG AAT CAA TAC GTA              240
||| ||| ||  ||  ||  ||| ||| ||| ||| ||| ||| ||| ||| ||| |||
CAT CCT AAC CCA CCC GAG AAT GTC CAG CTG GTG AAT CAA TAC GTA

Ser Lys Asn Val Ile Ser Ser Glu His Ile Val Glu Arg Glu Ala Glu
TCT AAA AAT GTC ATC TCT AGC GAG CAT ATT GTT GAG AGA GAG GCG GAG          288
||| ||| ||  ||| ||| ||  ||  ||| ||| ||| ||| ||| ||| ||| ||  |||
TCT AAA AAC GTC ATC TCC AGT GAG CAT ATT GTT GAG AGA GAG GCA GAG
```

Figure 13L'

```
Ser Ser Phe Ser Thr Ser His Tyr Thr Ser Thr Ala His His Ser Thr
AGC TCT TTT TCC ACC AGT CAC TAC ACT TCG ACA GCT CAT CAT TCC ACT    336
||| ||| ||| ||| ||| ||| ||| ||| ||| ||| ||| ||| ||| ||| ||| |||
ACA TCC TTT TCC ACC AGT CAC TAT ACT TCC ACA GCC CAT CAC TCC ACT
 T

Thr Val Gln Thr Pro Ser His Ser Trp Ser Asn Gly His Thr Glu
ACT GTC CAG ACT CCC AGT CAC AGC TGG AGC AAT GGA CAC ACT GAA        384
||| ||| ||| ||| ||| ||| ||| ||| ||| ||| ||| ||| ||| ||| |||
ACT GTC CAG ACC CCT AGC CAC AGC TGG AGC AAC GGA CAC ACT GAA

Ser Ile Ile Ser Glu Ser His Ser Val Ile Val Met Ser Ser Val Glu
AGC ATC ATT TCG GAA AGC CAC TCT GTC ATC GTG ATG TCA TCC GTA GAA    432
||| ||| ||| | | ||| ||| ||| ||| | | ||| ||| ||| ||| ||| ||| |||
AGC ATC ATT CTT TCC GAA AGC CAC TCT GTA ATC GTG ATG TCA TCC GTA GAA
         L

Asn Ser Arg His Ser Ser Pro Thr Gly Gly Pro Arg Gly Arg Leu Asn
AAC AGT AGG CAC AGC AGC CCG ACT GGC GGC CCG AGA CGT CTC AAT        480
||| ||| ||| ||| ||| ||| ||  ||| || ||| ||  ||| ||| ||| | | |||
AAC AGT AGG CAC AGC AGC CCA ACT GGG GGC CCA AGA CGT CTT AAT

Gly Leu Gly Gly Pro Arg Glu Cys Asn Ser Phe Leu Arg His Ala Arg
GGC TTG GGA GGC CCT CGT GAA TGT AAC AGC TTC CTC AGG CAT GCC AGA    528
|||     ||| || ||| ||| ||| ||| ||| ||| ||| ||| ||| ||| ||| |||
GGC ACA GGA GGA CCT CGT GAA TGT AAC AGC TTC CTC AGG CAT GCC AGA
     T

Glu Thr Pro Asp Ser Tyr Arg Asp Ser Pro His Ser Glu Arg
GAA ACC CCT GAC TCC TAC CGA GAC TCT CCT CAT AGT GAA AG             569
||| ||| ||| | | ||| ||| ||| ||| ||| ||| ||| ||| ||| ||
GAA ACC CCT GAT TCC TAC CGA GAC TCT CCT CAT AGT GAA AG
```

Figure 13M

CODING SEGMENT K:

```
A CAT AAC CTT ATA GCT GAG CTA AGG AGA AAC AAG GCC CAC AGA TCC                    46
  His Asn Leu Ile Ala Glu Leu Arg Arg Asn Lys Ala His Arg Ser

AAA TGC ATG CAG ATC CAG CTT TCC GCA ACT CAT CTT AGA GCT TCT TCC                   94
Lys Cys Met Gln Ile Gln Leu Ser Ala Thr His Leu Arg Ala Ser Ser

ATT CCC CAT TGG GCT TCA TCT AAG ACC CCT TGG CCT TTA GGA AG                       141
Ile Pro His Trp Ala Ser Phe Ser Lys Thr Pro Trp Pro Leu Gly Arg
```

Figure 13N
CODING SEGMENT L:

```
    Tyr Val Ser Ala Met Thr Thr Pro Ala Arg Met Ser Pro Val Asp
  G TAT GTA TCA GCA ATG ACC ACC CCG GCT CGT ATG TCA CCT GTA GAT       46
  | ||| || ||| ||| ||| ||| ||| ||| ||| ||| ||| ||| ||| ||| |||
  G TAT GTG TCA GCC ATG ACC CCG GCT CGT ATG TCA CCT GTA GAT

Phe His Thr Pro Ser Ser Pro Lys Ser Pro Pro Ser Glu Met Ser Pro
    TTC CAC ACG CCA AGC TCC CCC AAG TCA CCC CCT TCG GAA ATG TCC CCG   94
    ||| ||| ||| ||| ||| ||| ||| |-| ||| ||| ||| ||| ||| ||| ||| |-|
    TTC CAC ACG CCA AGC TCC CCC AAA TCG CCC CCT TCG GAA ATG TCT CCA

Pro Val Ser Ser Thr Thr Val Ser Met Pro Ser Met Ala Val Ser Pro
    CCC GTG TCC AGC ACG ACG GTC TCC ATG CCC TCC ATG GCG GTC AGT CCC   142
    ||| ||| ||| ||| |-| ||| ||| ||| ||| ||| ||| ||| ||| ||| |-| |||
    CCC GTG TCC AGC ACG GTG TCC ATG CCT TCC ATG GCG GTC AGC CCC

Phe Val Glu Glu Arg Pro Leu Leu Val Thr Pro Pro Arg Leu
    TTC GTG GAA GAG AGA CCC CTG CTT GTG ACG CCA CCA CGG CTG           190
    ||| ||| ||| ||| ||| ||| ||| |-| ||| ||| |-| ||| ||| |||
    TTC ATG GAA GAA GAG AGA CCT CTA CTC GTG ACA CCA CCA AGG CTG
        M       N

Arg Glu Lys   Tyr Asp His His Ala Gln Gln Phe Asn Ser Phe His
    CGG GAG AAG ... TAT GAC CAC CAC GCC CAG CAA TTC AAC TCG TTC CAC   238
    ||| ||| |||     |-| |-| ||| ||| |-| ||| ||| ||| ||| |-| ||| |||
    CGG GAG AAG     TTT GAC CAT CAC CCT CAG CAG TTC AGC TCC TTC CAC
                    F                 P

Cys Asn Pro Ala His Glu Ser Asn Ser Leu Pro Pro Ser Pro Leu Arg
    TGC AAC CCC GCG CAT GAG AGC AAC AGC CTG CCC CCC AGC TTG AGG       286
    |-| ||| ||| ||| |-| |-| ||| ||| ||| |-| |-| ||| ||| ||| ||| |||
    CAC AAC CCC GCG CAT GAC AGT AAC AGC CTC GCT CCT AGC CCC TTG AGG
                            D               A
```

Figure 13N'

```
Ile Val Glu Asp Glu Glu Tyr Glu Thr Thr Gln Glu Tyr Glu Pro Ala
ATA GTG GAG GAT GAG GAA TAT GAA ACG ACC CAG GAG TAC GAA CCA GCT
||| ||| ||| ||| ||| ||  ||| ||| ||| ||| ||| ||| ||| ||  ||| ||
ATA GTG GAG GAT GAG GAG TAT GAA ACG ACC CAA GAG TAC GAG CCA GCC      334

Gln Glu Pro Val Lys Lys Leu Thr Asn Ser Arg Ser Arg Arg Ala Lys Arg
CAA GAG CCG GTT AAG AAA CTC ACC AAC AGC AGC CGG CGG GCC AAA AGA
||| ||| ||  ||| ||| ||| ||| ||  ||| ||| ||| ||| ||| ||| ||| |||
CAA GAG CCT GTT AAG AAA CTC GCC ..T AGC CGG CGG GCC AAA AGA         382
                              A      N

Thr Lys Pro Asn Gly His Ile Ala His Arg Leu Glu Met Asp Asn Asn
ACC AAG CCC AAT GGT CAC ATT GCC CAC AGG TTG GAA ATG GAC AAC AAC
||| ||| ||  ||| ||  ||| ||| ||| ||| ||| ||| ||| ||  ||| ||  |||
ACC AAG CCC AAT GGC CAC ATT GCT AAC AGA AGA TTG GAA GTG GAC GCC AAC  430
                                    N                   V

Thr Gly Ala Asp Ser Ser Asn Ser Glu Ser Glu Thr Glu Asp Glu Arg
ACA GGC GCT GAC AGC AGT AAC AGT GAG TCA GAA ACA GAG GAT GAA AGA
||| ||  ||  ||| ||| ||| ||  ||| ||| ||| ||| ||| ||| ||| ||| |||
ACA AGC TCC CAG AGC AGT AAC TCA GAG TCA GAG ACA GAG GAT GAA AGA     478
    S   Q
```

Figure 13N"

```
    Val Gly Glu Asp Thr Pro Phe Leu Ala Ile Gln Asn Pro Leu Ala Ala
    GTA GGA GAA GAT ACG CCT TTC CTG GCC ATA CAG AAC CCC CTG GCA GCC
    ||| ||  ||| ||| ||| ||| ||| ||| |   ||| ||| ||| ||| ||| ||| |||
    GTA GGT GAA GAT ACG CCT TTC CTG GGC ATA CAG AAC CCC CTG GCA GCC    526
                                    G

Ser Leu Glu Ala Ala Pro Ala Phe Arg Leu Val Asp Ser Arg Thr Asn
    AGT CTC GAG GCG GCC CCT GCC TTC CGC CTG GTC GAC AGC AGG ACT AAC
    ||| ||  ||| ||| |   ||| ||| ||| ||| ||| |   ||| ||| ||| ||| |||
    AGT CTT GAG GCA GCA CCT GCC TTC CGC CTG GCT GAC AGC AGG ACT AAC    574
                T                            A

Pro Thr Gly Gly Phe Ser Pro Gln Glu Glu Leu Gln Ala Arg Leu Ser
    CCA ACA GGC GGC TTC TCT CCG CAG GAA GAA TTG CAG GCC AGG CTC TCC
    ||| |   ||| ||| ||| ||| |   ||| ||| ||| |   ||| ||| ||| ||| ||
    CCA GCA GGC CGC TTC CCT TCG ACA CAG GAA ATC CAG GCC AGG CTG TCT    622
      A                     T                  I

Gly Val Ile Ala Asn Gln Asp Pro Ile Ala Val *
    GGT GTA ATC GCT AAC CAA GAC CCT ATC GCT GTC TAA AAC CGA AAT ACA
    |   ||| ||  ||| ||| ||| ||| ||| ||  ||| ||| ||| ||| |   ||| |
    AGT GTA ATT GCT AAC CAA GAC CCT ATT GCT GTA TAA AAC CTA AAT AAA    672
    S

CCC ATA GAT TCA CCT GTA AAA CTT TAT ATA TAA TAA AGT ATT CCA
    |   ||| ||| ||| ||| ||| ||| ||| ||| ||| ||| ||| ||| ||| |
    CAC ATA GAT TCA CCT GTA AAA CTT TAT TTT ATA TAA TAA AGT ATT CCA    718

CCT TAA ATT AAA CAA
    ||| ||| ||| ||| |||
    CCT TAA ATT AAA CAA                                                733
```

Figure 13 O

HUMAN CODING SEGMENT E:

```
ATG AGA TGG CGA CGC GCC CCG CGC CGG TCC GGG CGT CCC GGC CCC CGG        48
Met Arg Trp Arg Arg Ala Pro Arg Arg Ser Gly Arg Pro Gly Pro Arg

GCC CAG CGC CCC GGC TCC GCC GCC CGC TCG CCG CCG CTG CCG CCG CTG        96
Ala Gln Arg Pro Gly Ser Ala Ala Arg Ser Pro Pro Leu Pro Pro Leu

CTG CCA CTA CTG CTG CTG GGG CTG ACC GCC CTG GCG CCG GGG GCG            144
Leu Pro Leu Leu Leu Leu Gly Leu Thr Ala Leu Ala Pro Gly Ala

GCG GCC GGC AAC GAG GCT GCA CCC CCC GCG GGG GCC TGC GTG TAC TCG       192
Ala Ala Gly Asn Glu Ala Ala Pro Pro Ala Gly Ala Cys Val Tyr Ser

TCC CCG CCC AGC GTG GGA TCG CAG CTA GTG CAG CAG CTA CAG GCC GCG       240
Ser Pro Pro Ser Val Gly Ser Val Gln Gln Leu Gln Arg Gln Ala Ala

GTG GTG ATC GAG GGA AAG GTG CAC CCG CAG CGG CAG CAG GGG GCA           288
Val Val Ile Glu Gly Lys Val His Pro Gln Arg Gln Gln Gly Ala

CTC GAC AGG AAG GCG GCG GCG GAG GCG GCA GGG GCA GGG TGG GGC           336
Leu Asp Arg Lys Ala Ala Ala Glu Ala Ala Gly Ala Gly Trp Gly

GGC GAT CGC GAG GAG CCG CCA GGG CCA CGG CTG GGG CCC CCG CCC           384
Gly Asp Arg Glu Glu Pro Pro Gly Pro Arg Ala Leu Gly Pro Pro

GCC GAG GAG CCG CTG CTC CTG AAC GCC ACC GTG CCC TCT TGG CCC           432
Ala Glu Glu Pro Leu Leu Asn Ala Thr Val Pro Ser Trp Pro

ACC GCC CCG GTG CCC AGC GCC GGG GGG GAG GCG CCC TAT            480
Thr Ala Pro Val Pro Ser Ala Gly Glu Glu Gly Ala Pro Tyr

CTG GTG AAG GTG CAC CAG CAG CAG GTG TGG GCG GTG AAA GCC GGG TTG AAG   528
Leu Val Lys Val His Gln Val Trp Ala Val Lys Ala Gly Leu Lys

AAG GAC TCG TCG CTC TTC ACC CGG GGG CTG GGG CAC CCC GCC           576
Lys Asp Ser Leu Leu Thr Val Arg Leu Gly Gly Tyr Gly His Pro Ala

TTC CCC TCC TGC GGG AGG CTC AAG GAG GAC TAC ATC TTC TTC           624
Phe Pro Ser Cys Gly Arg Leu Lys Glu Asp Tyr Ile Phe Phe

ATG GAG CCC GAC GCC ACC AGC AGC CGG CCG GCC TTC CGA                672
Met Glu Pro Asp Ala Thr Ser Arg Ala Pro Ala Phe Arg

GCC TCT TTC CCC CCT CTG GAG ACG GCG CGG ACT CTC AAG GAG GTC           720
Ala Ser Phe Pro Pro Leu Glu Thr Arg Thr Leu Asn Leu Lys Glu Val

AGC CGG GTG CTG TGC AAG CGG TGC G                                     745
Ser Arg Val Leu Cys Lys Arg Cys
```

Figure 14A

GGF2BPP5 Nucleotide Sequence & Deduced Protein Sequence

```
AGTTTCCCCC CCCAACTTGT CGGAACTCTG GGCTCGCGCG CAGGGCAGGA GCGGAGCGGC         60
GCGGGCTGCC CAGGCGATGC GAGCGCGGGC CGGACGGTAA TCGCCTCTCC CTCCTCGGGC        120
TGCGAGCGCG CCGGACCGAG GCAGCGACAG GAGCGGACCG CGGCGGGAAC CGAGGACTCC        180
CCAGCGGGGC GCCAGCAGGA GCCACCCCGC GAGCGTGCGA CCGGCGGACGA GGCCCCGCCA       240
GTCCCAGGTG GCCCGGACCG CACGTTGCGT CCCCGCGCTC CCCGCCGGCG ACAGGAGACG        300
CTCCCCCCCA CGCCGCGCGC GCCTCGGCGC GGTCGCTGCC CCGCCTCCAC TCCGGGGACA        360
AACTTTTCCC GAAGCCGATC CCAGCCCTCG GACCCAAACT TGTCGCGCGT CGCCTTCGCC        420
GGGAGCCGTC CGCGCAGAGC GTGCACTTCT CGGGCGAG ATG TCG GAG CGC AGA           475
                                          Met Ser Glu Arg Arg

GAA GGC AAA GGG AAG GGG GCT GGC AAG GAC CGA GGC TCC GGG                 523
Glu Gly Lys Gly Lys Gly Ala Gly Lys Asp Arg Gly Ser Gly

AAG AAG CCC GTG CCC GCG GGC GGC AGC GCC TTG CCT CCC                     571
Lys Lys Pro Val Pro Ala Gly Gly Ser Ala Leu Pro Pro
CGC TTG AAA GAG ATG AAG CAG TCT GTG GCA GGT TCC AAA CTA                 619
Arg Leu Lys Glu Met Lys Gln Ser Val Ala Gly Ser Lys Leu

GTG CTT CGG TGC GAG ACC AGT TCT GAA TAC TCC TCT CTC AAG TTC AAG         667
Val Leu Arg Cys Glu Thr Ser Ser Glu Tyr Ser Ser Leu Lys Phe Lys

TGG TTC AAG AAT GGG AGT GAA TTA AGC CGA AAG AAC CCA CAA AAC             715
Trp Phe Lys Asn Gly Ser Glu Leu Ser Arg Lys Asn Pro Gln Asn

ATC AAG ATA CAG AAA AGG CCG GGG AAG TCA GAA CTT CGC ATT AGC AAA         763
Ile Lys Ile Gln Lys Arg Pro Gly Lys Ser Glu Leu Arg Ile Ser Lys

GCG TCA CTG GCT GAT TCT GGA GAA TAT ATG TGC AAA GTG ATC AGC AAA         811
Ala Ser Leu Ala Asp Ser Gly Glu Tyr Met Cys Lys Val Ile Ser Lys
```

Figure 14B

GGF2BPP5 Nucleotide Sequence & Deduced Protein Sequence

| | |
|---|---|
| CTA GGA AAT GAC AGT GCC TCT GCC AAC ATC ACC ATT GTG GAG TCA AAC<br>Leu Gly Asn Asp Ser Ala Ser Ala Asn Ile Thr Ile Val Glu Ser Asn | 859 |
| GAG ATC ACC ACT GGC ATG CCA GCC TCA ACT GAG ACA GCG TAT GTG TCT<br>Glu Ile Thr Thr Gly Met Pro Ala Ser Thr Glu Thr Ala Tyr Val Ser | 907 |
| TCA GAG TCT CCC ATT AGA ATA TCA GTA TCA GAA GGA ACA AAT ACT<br>Ser Glu Ser Pro Ile Arg Ile Ser Val Ser Glu Gly Thr Asn Thr | 955 |
| TCT TCA TCC ACA TCT ACA GCT GGG ACA AGC CAT CTT GTC AAG<br>Ser Ser Ser Thr Ser Thr Ala Gly Thr Ser His Leu Val Lys | 1003 |
| TGT GCA GAG AAG CTT ACT TTC TGT GTG AAT GGA GGC GAG TGC TTC<br>Cys Ala Glu Lys Leu Thr Phe Cys Val Asn Gly Gly Glu Cys Phe | 1051 |
| ATG GTG AAA GAC CTT TCA AAT CCC TGC TAC AGA TAC TGC AAG TGC CCA<br>Met Val Lys Asp Leu Ser Asn Pro Cys Tyr Arg Tyr Cys Lys Cys Pro | 1099 |
| AAT GAG TTT ACT GGT GAT CGC TGC CAA AAC TAC GTA ATG GCC TTC<br>Asn Glu Phe Thr Gly Asp Arg Cys Gln Asn Tyr Val Met Ala Ser Phe | 1147 |
| TAC AGT ACG TCC ACT CCC TTT CTG TCT CTG CCT GAA TAGGCGCATG<br>Tyr Ser Thr Ser Thr Pro Phe Leu Ser Leu Pro Glu | 1193 |
| CTCAGTCGGT GCCGCTTTCT TGTTGCCGCA TCTCCCCTCA GATTCAACCT AGAGCTAGAT | 1253 |
| GCGTTTACC AGGTCTAACA TTGACTGCCT CTGCCTGTCG CATGAGAACA TTAACACAAG | 1313 |
| CGATTGTATG ACTTCCCTG TCCGTGACTA GTGGGCTCTG AGCTACTCGT AGGTGCGTAA | 1373 |
| GGCTCCAGTG TTTCTGAAAT TGATCTTGAA TTACTGTGAT ACGACATGAT AGTCCCTCTC | 1433 |
| ACCCAGTGCA ATGACAATAA AGGCCTTGAA AAGTCTCACT TTTATTGAGA AAATAAAAAT | 1493 |
| CGTTCCACGG GACAGTCCCT CTTCTTTATA AAATGACCCT ATCCTTGAAA AGGAGGTGTG | 1553 |
| TTAAGTTGTA ACCAGTACAC ACTTGAAATG ATGGTAAGTT CGCTTCGGTT CAGAATGTGT | 1613 |
| TCTTTCTGAC AAATAAACAG AATAAAAAAA AAAAAAAAA A | 1654 |

Figure 15A

GGF2BPP2 Nucleotide Sequence & Deduced Protein Sequence

```
CAT CAN TGG GCG GCG AAA GCC GGG GGC TTG AAG AAG GAC TCG CTG      48
His Gln Val Trp Ala Ala Lys Ala Gly Gly Leu Lys Lys Asp Ser Leu

CTC ACC GTG CGC CTG GGC GCC TGG GGC CAC CCC TTC CCC TCC TGC      96
Leu Thr Val Arg Leu Gly Ala Trp Gly His Pro Phe Pro Ser Cys

GGG CGC CTC AAG GAG GAC AGC AGG TAC ATC TTC TTC ATG GAG CCC     144
Gly Arg Leu Lys Glu Asp Ser Arg Tyr Ile Phe Phe Met Glu Pro

GCC AAC AGC AGC GGG GGC CCC CGC GGC CTT CCG AGC CTC CTT CCC     192
Ala Asn Ser Ser Gly Gly Pro Arg Gly Leu Pro Ser Leu Leu Pro

TCT CGA GAC GGG CCG GAA CAA CCT CAA GGA GGT CCG GGT GCT GTG     240
Ser Arg Asp Gly Pro Glu Gln Pro Gln Gly Gly Pro Gly Ala Val

CAA CGG TGC GCC TTG CCT CCC CGC TTG ATG GAG AAG CAG CAG GAG     288
Gln Arg Cys Ala Leu Pro Pro Arg Leu Met Glu Lys Gln Gln Glu

TCT GTG GCA GGT TCC AAA CTA GTG CTT CGG TGC GAG ACC TCT GAA     336
Ser Val Ala Gly Ser Lys Leu Val Leu Arg Cys Glu Thr Ser Glu

TAC TCC TCT CTC AAG TTC AAG TGG TTC AAT GGG AGT GAA TTA AGC     384
Tyr Ser Ser Leu Lys Phe Lys Trp Phe Asn Gly Ser Glu Leu Ser

CGA AAG AAC CCA GAA AAC ATC AAG ATA CAG AAA AGG CCG GGG AAG     432
Arg Lys Asn Pro Glu Asn Ile Lys Ile Gln Lys Arg Pro Gly Lys

TCA GAA CTT CGC ATT AGC AAA GCG TCA CTG GCT GAT TCT GGA GAA TAT 480
Ser Glu Leu Arg Ile Ser Lys Ala Ser Leu Ala Asp Ser Gly Glu Tyr

ATG TGC AAA GTG ATC AGC ATC AAA CTA GGA AAT GAC AGT GCC TCT AAC 528
Met Cys Lys Val Ile Ser Ile Lys Leu Gly Asn Asp Ser Ala Ser Asn
```

Figure 15B

GGF2BPP2 Nucleotide Sequence & Deduced Protein Sequence

```
ATC ACC ATT GTG GAG TCA AAC GCC ACA TCC ACA TCT ACA GCT GGG ACA    576
Ile Thr Ile Val Glu Ser Asn Ala Thr Ser Thr Ser Thr Ala Gly Thr

AGC CAT CTT GTC AAG TGT GCA GAG AAG GAG AAA ACT TTC TGT GTG AAT    624
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    672
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT    720
Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT    768
Val Pro Met Lys Val Gln Thr Gln Glu Lys Cys Pro Asn Glu Phe Thr

GGT GAT CGC TGC CAA AAC TAC GTA ATG GCC AGC TTC TAC AGT ACG TCC    816
Gly Asp Arg Cys Gln Asn Tyr Val Met Ala Ser Phe Tyr Ser Thr Ser

ACT CCC TTT CTG TCT CTG CCT GAA TAGGGCATCT CAGTCGGTGC CGCTTTCTTG    870
Thr Pro Phe Leu Ser Leu Pro Glu

TTGCCGCATC TCCCCTCAGA TTCCNCCTAG AGCTAGATGC GTTTTACCAG GTCTAACATT    930

GACTGCCTCT GCCTGTCGCA TGAGAACATT AACACAAGCG ATTGTATGAC TTCCCTCTGTC   990

CGTGACTAGT GGGCTCTGAG CTACTCGTAG GTGCCTAAGG CTCCAGTGTT TCTGAAATTG   1050

ATCTTGAATT ACTGTGATAC GACATGATAG TCCCTCTCAC CCAGTGCAAT GACAATAAAG   1110

GCCTTGAAAA GTCAAAAAAA AAAAAAAAAA                                   1140
```

Figure 16A

GGF2BPP4 Nucleotide Sequence & Deduced Protein Sequence

```
G AAG TCA GAA CTT CGC ATT AGC AAA GCG TCA CTG GCT GAT TCT GGA GAA        49
  Lys Ser Glu Leu Arg Ile Ser Lys Ala Ser Leu Ala Asp Ser Gly Glu

TAT ATG TGC AAA GTG ATC AGC GAG CTA GGA AAT GAC AGT GCC TCT GCC          97
Tyr Met Cys Lys Val Ile Ser Glu Leu Gly Asn Asp Ser Ala Ser Ala

AAC ATC ACC ATT GTG GAG TCA AAC GCC ACA TCC ACA TCT ACA GCT GGG        145
Asn Ile Thr Ile Val Glu Ser Asn Ala Thr Ser Thr Ser Thr Ala Gly

ACA AGC CAT CTT GTC AAG TGT GCA GAG GAG AAG AAA ACT TTC TGT GTG        193
Thr Ser His Leu Val Lys Cys Ala Glu Glu Lys Lys Thr Phe Cys Val

AAT GGA GGC GAC TGC TTC ATG GTG AAA GAC CTT TCA AAT CCC TCA AGA        241
Asn Gly Gly Asp Cys Phe Met Val Lys Asp Leu Ser Asn Pro Ser Arg

TAC TTG TGC AAG TGC CAA CCT GGA TTC ACT GGA GCG AGA TGT ACT GAG        289
Tyr Leu Cys Lys Cys Gln Pro Gly Phe Thr Gly Ala Arg Cys Thr Glu

AAT GTG CCC ATG AAA GTC CAA ACC CAA GAA AAA GCG GAG GAG CTC TAC        337
Asn Val Pro Met Lys Val Gln Thr Gln Glu Lys Ala Glu Glu Leu Tyr

CAG AAG AGA CTC ACC ATT ACC GGC ATT GCG ATC GCG CTG CTC GTG            385
Gln Lys Arg Leu Thr Ile Thr Gly Ile Ala Cys Ile Ala Leu Leu Val

GTT GGC ATC ATG ATG TGT GTG GTC TAC TGC AAA ACC AAA CAA CGG            433
Val Gly Ile Met Met Cys Val Val Tyr Cys Lys Thr Lys Gln Arg

AAA AAG CTT CAT GAC CGG CTT CGG CAG AGC CTT CGG TCT GAA AGA AAC        481
Lys Lys Leu His Asp Arg Leu Arg Gln Ser Leu Arg Ser Glu Arg Asn

ACC ATG ATG ATG AAC GTA GCC AAC GGG CCC CAC CAC CCC AAT CCG CCC        529
Thr Met Met Met Asn Val Ala Asn Gly Pro His His Pro Asn Pro Pro

GAG AAC GTG CAG CTG GTG AAT CAA TAC GTA TCT AAA AAT GTC ATC TCT        577
Glu Asn Val Gln Leu Val Asn Gln Tyr Val Ser Lys Asn Val Ile Ser
```

Figure 16B

GGF2BPP4 Nucleotide Sequence & Deduced Protein Sequence

```
GC  GAG CAT ATT GTT GAG AGA GAG GCG GAG AGC TCT TTT TCC ACC AGT    625
Ser Glu His Ile Val Glu Arg Glu Ala Glu Ser Ser Phe Ser Thr Ser

CAC TAC ACT TCG ACA GCT CAT CAT TCC ACT ACT GTC ACT CAG ACT CCC    673
His Tyr Thr Ser Thr Ala His His Ser Thr Thr Val Thr Gln Thr Pro

AGT CAC AGC TGG AGC AAT GGA CAC ACT GAA AGC ATC ATT TCG GAA AGC    721
Ser His Ser Trp Ser Asn Gly His Thr Glu Ser Ile Ile Ser Glu Ser

CAC TCT GTC ATC GTG ATG TCA GTA GAA AAC AGT AGG CAC AGC AGC        769
His Ser Val Ile Val Met Ser Val Glu Asn Ser Arg His Ser Ser

CCG ACT GGG GGC CCG AGA GGA CGT CTC AAT GGC TTG GGA CCT CGT        817
Pro Thr Gly Gly Pro Arg Gly Arg Leu Asn Gly Leu Gly Pro Arg

GAA ACT AGC TTC CTC CTC AGG CAT GCC AGA GAA ACC CCT GAC TCC TAC    865
Glu Cys Asn Ser Phe Leu Arg His Ala Arg Glu Thr Pro Asp Ser Tyr

CGA GAC TCT CCT CAT AGT GAA AGA CAT AAC CTT ATA GCT GAG CTA AGG    913
Arg Asp Ser Pro His Ser Glu Arg His Asn Leu Ile Ala Glu Leu Arg

AGA AAC AAG GCC CAC AGA TCC AAA TGC ATG CAG ATC CAG CTT TCC GCA    961
Arg Asn Lys Ala His Arg Ser Lys Cys Met Gln Ile Gln Leu Ser Ala

ACT CAT CTT AGA GCT TCT CCC ATT CCC CAT TGG GCT TCA TTC AAG       1009
Thr His Leu Arg Ala Ser Ser Ile Pro His Trp Ala Ser Phe Lys

ACC CCT TGG GGA TTA GGA AGG TAT GTA TCA GCA ATG ACC AAG CCG GCT   1057
Thr Pro Trp Gly Leu Gly Arg Tyr Val Ser Ala Met Thr Thr Pro Ala

CGT ATG TCA CCT GTA GAT TTC CAC ACG TTC CCA AAG TCA CCC           1105
Arg Met Ser Pro Val Asp Phe His Thr Phe Pro Lys Ser Pro

CCT TCG GAA ATG TCC CCG GTG TCC AGC ACG GTC TCC ATG CCC           1153
Pro Ser Glu Met Ser Pro Val Pro Ser Thr Ser Val Ser Met Pro
```

Figure 16C

GGF2BPP4 Nucleotide Sequence & Deduced Protein Sequence

```
TCC ATG GCG GTC AGT CCC TTC GAA GAG GTG AGA CCC CTG CTC CTT    1201
Ser Met Ala Val Ser Pro Phe Glu Glu Val Arg Pro Leu Leu Leu

GTG ACG CCA CTG CGG GAG AAG TAT GAC CAC GCC CAG CAA            1249
Val Thr Pro Leu Arg Glu Lys Tyr Asp His Ala Gln Gln

TTC AAC TCG TTC CAC TGC AAC CCC GCG CAT GAG AGC AGC CTG CCC    1297
Phe Asn Ser Phe His Cys Asn Pro Ala His Glu Ser Asn Leu Pro

CCC AGC CCC TTG AGG ATA GTG GAG GAT GAG GAA TAT GAA ACC CAG    1345
Pro Ser Pro Leu Arg Ile Val Glu Asp Glu Glu Tyr Glu Thr Gln

GAG TAC GAA CCA GCT CAA GAG GTT CCG AAG AAA CTC AAC AGC AGC    1393
Glu Tyr Glu Pro Ala Gln Glu Val Pro Val Lys Lys Leu Asn Ser Ser

CGG CGG GCC AAA AGA ACC ACC AAG AAG CTC CAC ATT GCC AGG TTG    1441
Arg Arg Ala Lys Arg Thr Thr Lys Lys Leu His Ile Ala Arg Leu

GAA ATG GAC AAC ACA GGC GTA GCT GAC AGT AAC TCA GAG AGC GAA    1489
Glu Met Asp Asn Thr Gly Val Ala Asp Ser Asn Ser Glu Glu

ACA GAG GAT GAA AGA GTA GGA GAT ACG CCT TTC CTG GCC ATA CAG    1537
Thr Glu Asp Glu Arg Val Gly Asp Thr Pro Phe Leu Ala Ile Gln

AAC CCC CTG GCA GCC CTC CTC GAG GCG GCC CCT TTC CGC CTG GTC    1585
Asn Pro Leu Ala Ala Ser Leu Glu Ala Ala Pro Phe Arg Leu Val

GAC AGC AGG ACT AAC CCA ACA GGC GGC TTC TCT CCG CAG GAA TTG    1633
Asp Ser Arg Thr Asn Pro Thr Gly Gly Phe Ser Pro Gln Glu Leu

CAG GCC AGG CTC TCC GGT GTA ATC GCT AAC CAA GAC CCT ATC GCT GTC 1681
Gln Ala Arg Leu Ser Gly Val Ile Ala Asn Gln Asp Pro Ile Ala Val

TAAAACCGAA ATACACCCAT AGATTCACCT GTAAAACTTT ATTTATATA ATAAAGTATT 1741
CCACCTTAAA TTAAACAAAA AAA                                      1764
```

Figure 17 A

GGF/Heregulin Splicing Variants

GGF/Heregulin Splicing Variants

EGFL1

```
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC   144
Leu Cys Lys Cys Pro Asn Glu Phe Thr Gly Asp Arg Cys Gln Asn Tyr

GTA ATG GCC AGC TTC TAC AGT ACG TCC ACT CCC TTT CTG TCT CTG CCT   192
Val Met Ala Ser Phe Tyr Ser Thr Ser Thr Pro Phe Leu Ser Leu Pro

GAA TAG                                                            198
Glu
```

Figure 19

EGFL2

```
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT   144
Leu Cys Lys Cys Gln Pro Gly Phe Thr Gly Ala Arg Cys Thr Glu Asn

GTG CCC ATG AAA GTC CAA ACC CAA GAA AAA GCG GAG GAG CTC TAC TAA   192
Val Pro Met Lys Val Gln Thr Gln Glu Lys Ala Glu Glu Leu Tyr
```

Figure 20

EGFL3

```
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CCA AAT GAG TTT ACT GGT GAT CGC TGC CAA AAC TAC   144
Leu Cys Lys Cys Pro Asn Glu Phe Thr Gly Asp Arg Cys Gln Asn Tyr

GTA ATG GCC AGC TTC TAC AAA GCG GAG GAG CTC TAC TAA               183
Val Met Ala Ser Phe Tyr Lys Ala Glu Glu Leu Tyr
```

Figure 21

EGFL4

```
AGC CAT CTT GTC AAG TGT GCA GAG AAG GAG AAA ACT TTC TGT GTG AAT
Ser His Leu Val Lys Cys Ala Glu Lys Glu Lys Thr Phe Cys Val Asn    48

GGA GGC GAG TGC TTC ATG GTG AAA GAC CTT TCA AAT CCC TCA AGA TAC
Gly Gly Glu Cys Phe Met Val Lys Asp Leu Ser Asn Pro Ser Arg Tyr    96

TTG TGC AAG TGC CCA AAT GAG TTT ACT GGT GAT CGC TGC CAA AAC TAC
Leu Cys Lys Cys Pro Asn Glu Phe Thr Gly Asp Arg Cys Gln Asn Tyr   144

GTA ATG GCC AGC TTC TAC AAG CAT CTT GGG ATT GAA TTT ATG GAG AAA
Val Met Ala Ser Phe Tyr Lys His Leu Gly Ile Glu Phe Met Glu Lys   192

GCG GAG GAG CTC TAC TAA
Ala Glu Glu Leu Tyr                                                210
```

Figure 22

EGFL5

| | | | | | | | |
|---|---|---|---|---|---|---|---|
| AGC | CAT | CTT | GTC | AAG | TGT | GCA | GAG | AAG | GAG | AAA | ACT | TTC | TGT | GTG | AAT | 48
| Ser | His | Leu | Val | Lys | Cys | Ala | Glu | Lys | Glu | Lys | Thr | Phe | Cys | Val | Asn |

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT   144
Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT   192
Val Pro Met Lys Val Gln Thr Gln Glu Lys Cys Pro Asn Glu Phe Thr

GGT GAT CGC TGC CAA AAC TAC GTA ATG GCC AGC TTC TAC AGT ACG TCC   240
Gly Asp Arg Cys Gln Asn Tyr Val Met Ala Ser Phe Tyr Ser Thr Ser

ACT CCC TTT CTG TCT CTG CCT GAA TAG                               267
Thr Pro Phe Leu Ser Leu Pro Glu

Figure 23
EGFL6

```
AGC CAT CTT GTC AAG TGT GCA GAG AAG GAG AAA ACT TTC TGT GTG AAT    48
Ser His Leu Val Lys Cys Ala Glu Lys Glu Lys Thr Phe Cys Val Asn

GGA GGC GAG TGC TTC ATG GTG AAA GAC CTT TCA AAT CCC TCA AGA TAC    96
Gly Gly Glu Cys Phe Met Val Lys Asp Leu Ser Asn Pro Ser Arg Tyr

TTG TGC AAG TGC CAA CCT GGA TTC ACT GGA GCG AGA TGT ACT GAG AAT   144
Leu Cys Lys Cys Gln Pro Gly Phe Thr Gly Ala Arg Cys Thr Glu Asn

GTG CCC ATG AAA GTC CAA ACC CAA GAA AAG TGC CCA AAT GAG TTT ACT   192
Val Pro Met Lys Val Gln Thr Gln Glu Lys Cys Pro Asn Glu Phe Thr

GGT GAT CGC TGC CAA AAC TAC GTA ATG GCC AGC TTC TAC AAA GCG GAG   240
Gly Asp Arg Cys Gln Asn Tyr Val Met Ala Ser Phe Tyr Lys Ala Glu

GAG CTC TAC TAA                                                   252
Glu Leu Tyr
```

Figure 24A

Nucleotide Sequence & Deduced Acid Sequence of GGF2HBS5

```
GGAATTCCTT TTTTTTTT  TTTTTTCT  NNTTTTTTT  TGCCCTTATA  CCTCTTCGCC      60
TTTCTGTGT  TCCATCCACT TCTTCCCCCT CCTCCTCCCA TAAACAACTC TCCTACCCCT    120
GCACCCCAA  TAAATAAATA AAAGGAGGAG GGCAAGGGGG GAGGAGGAGG AGTGGTGCTG    180
CGAGGGAAG  GAAAAGGGAG GCAGCGCGAG AAGAGCCCGG CAGAGTCCGA ACCGACAGCC    240
AGAAGCCCGC ACGCACCCTG CACC ATG AGA TGG CGA CGC GCC CCG CGC CGC       291
                           Met Arg Trp Arg Arg Ala Pro Arg Arg

TCC GGG CGT CCC GGC GCC CGG GCC CAG CGC CCC GGC TCC GCC GCC CGC     339
Ser Gly Arg Pro Gly Ala Arg Ala Gln Arg Pro Gly Ser Ala Ala Arg

TCG TCG CCG CCG CTG CTG CCG CTA CTG CCA CTA CTG CTG CTG CTG ACC    387
Ser Ser Pro Pro Leu Leu Pro Leu Leu Pro Leu Leu Leu Leu Leu Thr
                                                    Val Cys Leu Leu Thr Val
                                                              GGF-II 09

GCG GCC CTG GCG GCG CCG GGG GCG GCC GGC AAC GAG GCG GCT CCC GCG    435
Ala Ala Leu Ala Ala Pro Gly Ala Ala Gly Asn Glu Ala Ala Pro Ala

GGG GCC TCG GTG TGC TAC TCG TCC CCG CCC AGC GTG GGA TCG GTG CAG    483
Gly Ala Ser Val Cys Tyr Ser Ser Pro Pro Ser Val Gly Ser Val Gln
                                    Ala Ser Pro Val Ser Val Gly Ser Val Gln
                                                        GGF-II 08

GAG CTA GCT CAG CGC GCC GCG GTG GTG ATC GAG GGA AAG CAC CCG        531
Glu Leu Ala Gln Arg Ala Ala Val Val Ile Glu Gly Lys Val His Pro
Glu Leu Val Gln Arg Trp Phe Val Val Ile Glu Gly Lys
                           GGF-II 04
```

Figure 24B
Nucleotide Sequence & Deduced Acid Sequence of GGF2HBS5

```
CAG CGG CAG CAG GGG GCA CTC GAC AGG AAG GCG GCG GCG GCG·GCG    579
Gln Arg Gln Gln Gly Ala Leu Asp Arg Lys Ala Ala Ala Ala Ala

GGC GAG GCA GGG GCG TGG GGC GGT GAT CGC GAG CCA GCC GCG GGC    627
Gly Glu Ala Gly Ala Trp Gly Gly Asp Arg Glu Pro Ala Ala Gly

CCA CGG GCG CTG GGG CCG GCC GAG GAG CCG CTG CTC GCC GCC AAC    675
Pro Arg Ala Leu Gly Pro Ala Glu Glu Pro Leu Leu Ala Ala Asn

GGG ACC GTG CCC TCT TGG CCC ACC GCC CCG GTG CCC AGC GGC GAG    723
Gly Thr Val Pro Ser Trp Pro Thr Ala Pro Val Pro Ser Ala Gly Glu

CCC GGG GAG GAG GCG CCC TAT CTG GTG AAG GTG CAC CAG GTG TGG GCG    771
Pro Gly Glu Glu Ala Pro Tyr Leu Val Lys Val His Gln Val Trp Ala
                                    Lys Val His Glu Val Trp Ala
                                         GGF-II 01 & GGF-II 11

GTG AAA GCC GGG GGC TTG AAG AAG GAC TCG CTC ACC GTG CGC CTG    819
Val Lys Ala Gly Gly Leu Lys Lys Asp Ser Leu Thr Val Arg Leu
Ala Lys               Asp Leu Leu Leu Xaa Val    Leu
                              GGF-II 10

GGG ACC TGG GGC CAC CCC GCC TTC CCC TCC TGC GGG CTC AAG GAG    867
Gly Thr Trp Gly His Pro Ala Phe Pro Ser Cys Gly Arg Leu Lys Glu
Gly Ala Trp Gly Pro Pro Ala Phe Pro Val Xaa Tyr
         GGF-II 03

GAC AGC AGG TAC ATC TTC TTC ATG GAG CCC GAC GCC AAC AGC ACC AGC    915
Asp Ser Arg Tyr Ile Phe Phe Met Glu Pro Asp Ala Asn Ser Thr Ser
Tyr Ile Phe Phe Met Glu Pro Gla Ala Xaa Ser Ser Gly
                    GGF-II 02
```

Figure 24C

Nucleotide Sequence & Deduced Acid Sequence of GGF2HBS5

```
CGC GCG CCG GCC GCC TTC CGA GCC TCT TTC CCC CCT CTG GAG ACG GGC    963
Arg Ala Pro Ala Ala Phe Arg Ala Ser Phe Pro Pro Leu Glu Thr Gly

CGG AAC CTC AAG AAG GAG GTC GAG AGC CGG CTG TGC AAG CGG TGC GCC   1011
Arg Asn Leu Lys Lys Glu Val Ser Arg Val Leu Cys Lys Arg Cys Ala

TTG CCT CCC CAA TTG AAA GAG ATG AAA AGC CAG GAA TCG GCT GCA GGT   1059
Leu Pro Pro Gln Leu Lys Glu Met Lys Ser Gln Glu Ser Ala Ala Gly

TCC AAA CTA GTC CTT CGG TGT GAA ACC AGT TCT GAA TAC TCC TCT CTC   1107
Ser Lys Leu Val Leu Arg Cys Glu Thr Ser Ser Glu Tyr Ser Ser Leu
Leu Val Leu Arg
    GGF-II 06

AGA TTC AAG TGG TTC AAG AAT GGG AAT GAA TTG AAT CGA AAA AAC AAA   1155
Arg Phe Lys Trp Phe Lys Asn Gly Asn Glu Leu Asn Arg Lys Asn Lys

CCA CAA AAT ATC AAG ATA CAA AAG AAG CCA GGG AAG TCA GAA CTT CGC   1203
Pro Gln Asn Ile Lys Ile Gln Lys Lys Pro Gly Lys Ser Glu Leu Arg

ATT AAC AAA GCA TCA CTG GCT GAT TCT GGA GAG TAT ATG TGC AAA GTG   1251
Ile Asn Lys Ala Ser Leu Ala Asp Ser Gly Glu Tyr Met Cys Lys Val
Lys Ala Ser Leu Ala Asp Ser Gly Glu Tyr Met Xaa Lyx →
                                                GGF-II 12

ATC AGC AAA TTA GGA AAT GAC AGT GCC TCT GCC AAT ATC ACC ATC GTG   1299
Ile Ser Lys Leu Gly Asn Asp Ser Ala Ser Ala Asn Ile Thr Ile Val

GAA TCA AAC GCT ACA TCT ACA ACC TCC ACC ACT GGG ACA AGC CAT CTT GTA 1347
Glu Ser Asn Ala Thr Ser Thr Thr Ser Thr Thr Gly Thr Ser His Leu Val
```

Figure 24D

Nucleotide Sequence & Deduced Acid Sequence of GGF2HBS5

```
AAA TGT GCG GAG AAG GAG AAA ACT TTC TGT GTG AAT GGA GGG GAG TGC          1395
Lys Cys Ala Glu Lys Glu Lys Thr Phe Cys Val Asn Gly Gly Glu Cys

TTC ATG GTG AAA GAC CTT TCA AAC CCC TCG AGA TAC TTG TGC AAG TGC          1443
Phe Met Val Lys Asp Leu Ser Asn Pro Ser Arg Tyr Leu Cys Lys Cys

CCA AAT GAG TTT ACT GGT GAT CGC TGC CAA AAC TAC GTA ATG GCC AGC          1491
Pro Asn Glu Phe Thr Gly Asp Arg Cys Gln Asn Tyr Val Met Ala Ser

TTC TAC AGT ACG TCC ACT CCC TTT CTG TCT CCT GAA                          1530
Phe Tyr Ser Thr Ser Thr Pro Phe Leu Ser Pro Glu

TAGGAGCATG CTCAGTTGGT GCTGCTTTCT TGTTGCTGCA TCTCCCCTCA GATTCCACCT        1590

AGAGCTAGAT GTGTCTTACC AGATCTAATA TTGACTGCCT CTGCCTGTCG CATGAGAACA        1650

TTAACAAAAG CAATTGTATT ACTTCCCTCTG TTCGCGACTA GTTGGCTCTG AGATACTAAT       1710

AGGTGTGTGA GGCTCCGGAT GTTTCTGGAA TTGATATTGA ATGATGTGAT ACAAATTGAT        1770

AGTCAATATC AAGCAGTGAA ATATGATAAT AAAGGCATTT CAAAGTCTCA CTTTTATTGA        1830

TAAAATAAAA ATCATTCTAC TGAACAGTCC ATCTTCTTTA TACAATGACC ACATCCTGAA        1890

AAGGGTGTTG CTAAGCTGTA ACCGATATGC ACTTGAAATG ATGGTAAGTT AATTTTGATT        1950

CAGAATGTGT TATTTGTCAC AAATAAACAT AATAAAAGGA AAAAAAAAA AAA               2003
```

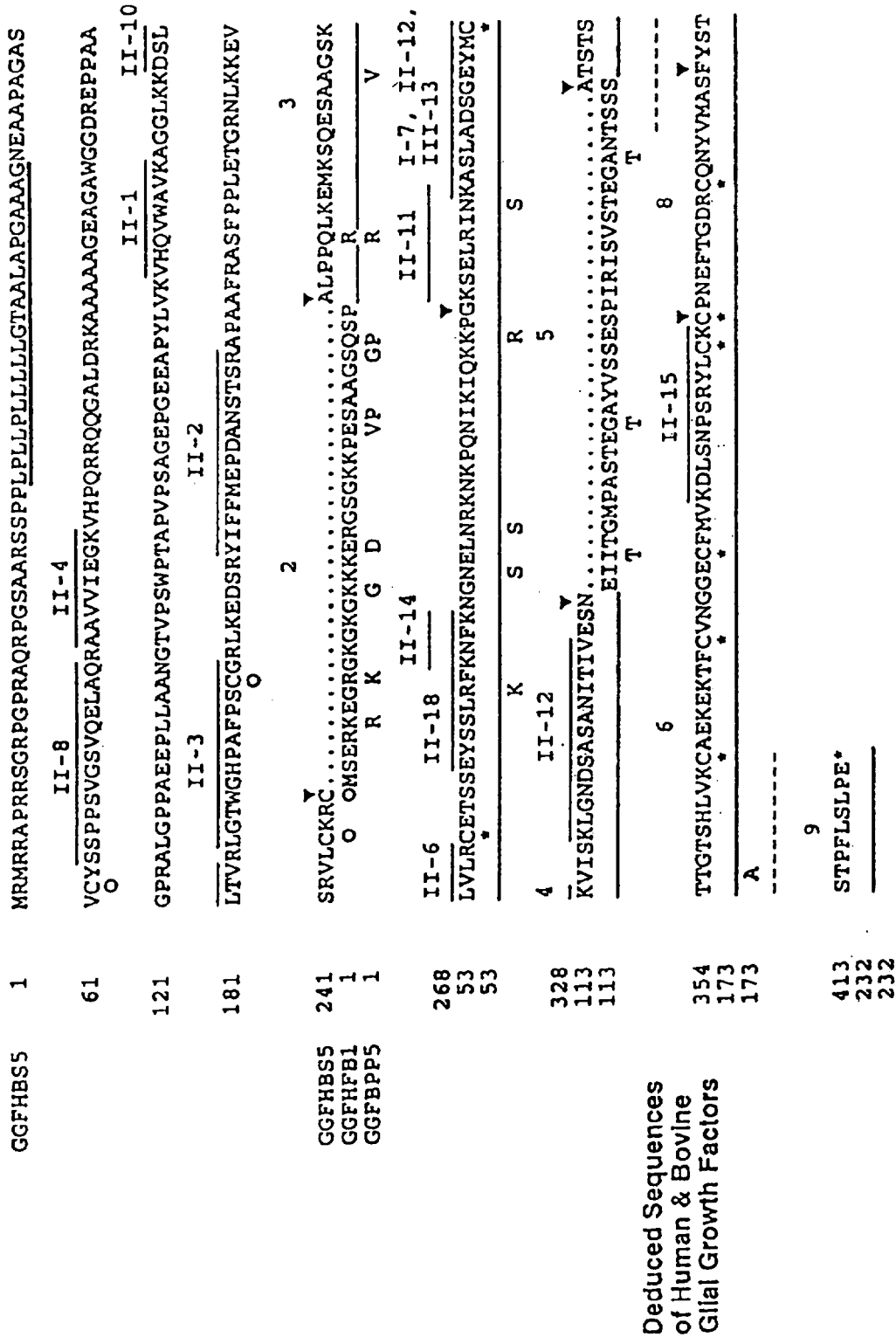

Figure 26

```
  1 HRWRRAPRRS GRPGPRAQRP GSAARSSPPL PLLPLLLLLG TAALAPGAAA
 51 GNEAAPAGAS VCYSSPPSVG SVQELAQRAA VVIEGKVHPQ RRQQGALDRK
101 AAAAAGEAGA WGGDREPPAA GPRALGPPAE EPLLAANGTV PSWPTAPVPS
151 AGEPGEEAPY LVKVHQVWAV KAGGLKKDSL LTVRLGTWGH PAFPSCGRLK
201 EDSRYIFFME PDANSTSRAP AAFRASFPPL ETGRNLKKEV SRVLCKRCAL
251 PPQLKEMKSQ ESAAGSKLVL RCETSSEYSS LRFKWFKNGN ELNRKNKPQN
301 IKIQKKPGKS ELRINKASLA DSGEYMCKVI SKLGNDSASA NITIVESNAT
351 STSTTGTSHL VKCAEKEKTF CVNGGECFMV KDLSNPSRYL CKCPNEFTGD
401 RCQHYVMASF YSTSTPFLSL PE*
```

Figure 27

Putative Bovine Factor II Gene Sequences

```
TCTAA AAC TAC AGA GAC TGT ATT TTC ATG ATC ATA GTT CTG TGA AAT ATA         53
      Asn Tyr Arg Asp Cys Ile Phe Met Ile Ile Val Leu Xaa Asn Ile

CTT AAA CCG CTT TGG TCC TGA TCT TGT AGG AAG TCA GAA CTT CGC ATT          101
Leu Lys Pro Leu Trp Ser Xaa Ser Cys Arg Lys Ser Glu Leu Arg Ile

AGC AAA GCG TCA CTG GCT GAT TCT GGA GAA TAT ATG TGC AAA GTG ATC          149
Ser Lys Ala Ser Leu Ala Asp Ser Gly Glu Tyr Met Cys Lys Val Ile

AGC AAA CTA GGA AAT GAC AGT GCC TCT GCC AAC ATC ACC ATT GTG GAG          197
Ser Lys Leu Gly Asn Asp Ser Ala Ser Ala Asn Ile Thr Ile Val Glu

TCA AAC GGT AAG AGA TGC CTA CTG CGT GCT TCT CAG TCT CTA AGA              245
Ser Asn Gly Lys Arg Cys Leu Leu Arg Ala Ile Ser Gln Ser Leu Arg

GGA GTG ATC AAG GTA TGT GGT CAC ACT TGA ATC ACG CAG GTG TGT GAA          293
Gly Val Ile Lys Val Cys Gly His Thr Xaa Ile Thr Gln Val Cys Glu

ATC TCA TTG TGA ACA AAT AAA AAT CAT GAA AGG AAA ACT CTA TGT TTG          341
Ile Ser Cys Xaa Thr Asn Lys Asn His Glu Arg Lys Thr Leu Cys Leu

AAA TAT CTT ATG GGT CCT CCT GTA AAG CTC TTC ACT CCA TAA GGT GAA          389
Lys Tyr Leu Met Gly Pro Pro Val Lys Leu Phe Thr Pro Xaa Gly Glu

ATA GAC CTG AAA TAT ATA TAG ATT ATT T                                    417
Ile Asp Leu Lys Tyr Ile Xaa Ile Ile
```

METHODS OF TREATING DISORDERS OF THE EYE

This invention was made with the support of federal grants from the U.S. Government. The Government has certain rights in the invention.

FIELD OF THE INVENTION

This invention relates to methods of affecting retinal cell function.

BACKGROUND OF THE INVENTION

The invention relates to prophylactic or affirmative treatment of diseases and disorders of retina and associated tissues of the eye by administering polypeptides found in vertebrate species, which polypeptides are growth, differentiation and survival factors for several cell types. Normal function of retinal cells including survival, proliferation, differentiation, and maintenance is dependent upon the controlled expression of a variety of peptide growth factors. Some of these factors can be produced by neuronal cells and by other cells of the retina, which provide a signal to regulate retinal cell function.

Anatomy and Function of the Retina

The retina is that component of the visual system which senses light and transmits impulses via the optic nerve to the visual cortex where the signals are deciphered and interpreted as images. The retina is comprised of a series of layers and cell types as illustrated in FIG. 1.

The basic function of the retina is to transduce the visual image into a pattern of electrical potential changes that can be processed by the visual centers in the brain. The changes in electrical potentials in the retinal cells are then relayed to the brain. The structure of the retina reflects these functions (FIG. 1). The cells of the retina are arrayed in three layers: (1) the outer nuclear layer, which contains the photoreceptor cells; (2) the inner nuclear layer, which contains the cell nuclei of most of the retinal interneurons and glia; and (3) the ganglion cell layer, which contains the cell bodies, of the cells that relay the visual information to the brain via the optic nerve. In addition to these nuclear layers, there are three other distinct layers in the retina. The outermost layer is composed of the outer segments of the photoreceptor cells; this is where the actual process of light-to-electrical signal transduction take place. The outer plexiform layer lies between the outer and inner nuclear layers. It is made up of synapses between the terminals of the photoreceptors and the dendrites of the retinal interneurons of the inner nuclear layer. The inner plexiform layer lies between the inner nuclear layer and the ganglion cell layer. This layer is where the interneurons of the inner nuclear layer synapse with the retinal ganglion cell dendrites.

The retina is composed of five classes of neurons, and two classes of supporting cells (*Principles of Neural Science*, 3rd ed., Ed. by E. R. Kandel, J. H. Schwartz, and T. M. Jessell, Elsevier, New York, N.Y. 1991). Of the neuronal types, the receptor cells are the cells that transduce light into electrical signals. Receptor cells are of two subtypes: cones—which mediate form and color perception in daylight, and rods—which mediate form perception in dim light. Ganglion cells of the retina project axons into the brain via the optic nerve and are the output cells of the retina. The remaining neuronal types are interneurons that modulate retinal output: bipolar cells connect receptor cells to ganglion cells; horizontal cells mediate lateral interactions between receptors and bipolar cells; and amacrine cells mediate lateral interactions between bipolar cells and ganglion cells. The supporting cell types are the glial cells of the retina, Müller cells, and the pigment epithelium cells. The latter cell type plays an important role in the maintenance of receptor cells.

The basic flow of information through the retina is as follows (Refer to FIG. 1): (1) light passes through the cells of the retina and is absorbed by the outer segments of the photoreceptor cells; (2) the photons are transduced into potential changes in the photoreceptor cells; (3) this change in potential is relayed to one type of retinal interneuron in the inner nuclear layer, the bipolar cell, via synapses in the outer plexiform layer; (4) the bipolar cells relay the electrical potential changes to the ganglion cells through their synapses in the inner plexiform layer; and (5) the ganglion cells convert the potential changes into action potentials that are sent along the optic nerve to the brain. This process results in a pattern of action potentials in the optic nerves that reflects the pattern of light and dark in the visual world. Some initial processing of the visual information takes place in the retina before it is relayed to the other visual areas in the brain.

Proper development and maintenance of the retina is necessary for sustaining normal vision. Degeneration of components of the retina can lead to partial or total blindness.

Peptide Growth Factors

The development and physiology of multicellular organisms requires multiple modes of intercellular communication. Such communication may be systemic, as in the case of hormones delivered via the bloodstream, or can be highly localized. In the latter case two modes are commonly recognized: synaptic signaling from neurons, and paracrine signaling from adjacent or nearby cells (*Molecular Biology of the Cell*, Alberts et al., 2nd ed. Garland Publishing, New York, N.Y. 1989). A function of such signaling is to coordinate cell survival, proliferation, differentiation, and/or metabolic activity. The molecules that serve as transmitted signals vary in their chemical composition; one group of molecules are proteins, the peptide growth factors. Peptide growth factors act upon cells by binding to cell surface receptors. These receptors are coupled to intracellular signal transduction pathways that give rise to the above described activities when activated by growth factor binding. The genesis and differentiation of the varied retinal cell types and the generation of distinct layers in the retina from progenitor cells of the optic cup are the result of developmental events that are mediated by intercellular communication involving peptide growth factors.

Peptide Growth Factors in the Retina

The roles of growth factors in the development and maintenance of the retina have been studied in cell culture, by molecular analysis of the expressed growth factors and their receptors, and in animal models of disease or injury.

As an example of in vitro studies, explants and partially-dissociated chick retinal pigmented epithelium (RPE) can trans-differentiate into neural retina in the presence of bFGF (Coulombre and Coulombre, *Dev. Biol.* 12:79, 1965). Proliferation of dissociated RPE cells is stimulated by aFGF, bFGF, EGF, PDGF, IGF, and insulin; and it is inhibited by TGFb (Sternfeld et al., *Curr. Eye Res.* 8: 1029, 1989; Leschey et al., *Invest. Ophthalmol. Vis. Sci.* 31: 839, 1990; Song and Lui, *J. Cell Physiol.* 143:196, 1990). Cultured RPE cells are induced by cytokines to release nitric oxide, which is cytotoxic—and the induction can be blocked by FGF (Goureau et al., *Biochem. Biophys Res. Comm.* 186:854, 1992; op. cit., 198: 120, 1994). Further, retinal explants from the rd mouse are rescued from cell death by combined treatment with NGF and bFGF (Caffe et al., *Curr. Eye Res.* 12:719, 1993).

The presence of growth factor receptors in retinal cells has been demonstrated by a variety of molecular analytical techniques, including immunostaining, in situ hybridization and tissue binding using radio-labeled ligands. Cells in the RPE express FGF receptors (Malecaze et al., *J. Cell Physiol.* 154: .1105, 1993). Ganglion cells and Müller cells express receptors for BDNF, CNTF, FGF, trkA and trkB (Jelsma et al., *J. Neurobiol.* 24:1207, 1993; Takahashi et al., *Neurosci. Lett.* 151:174, 1993; Carmignoto et al., *Exp. Neurol.* 111:302 191; reviewed in Steinberg, *Curr. Opin. Neurobiol.* 4:515, 1994). Müller cells also express PDGF receptors (Mudhar et al., *Development* 118: 539, 1993). Receptors for IGF are detected on photoreceptor cells (Waldbillig et al., *Exp. Eye Res.* 47:587 1988; Ocrant et al., *Exp. Eye Res.* 52:581, 1991), and depending on the species and developmental stage that are analyzed receptors for bFDF have been localized on several cell types, including retinal ganglion cells (Sternfeld et al., *Curr. Eye Res.* 8:1029, 1992; Sch-weigerer et al., *Biochem Biophys. Res. Comm.* 143:934, 1987).

Studies on retinal ganglion cell survival in vivo in animal models of optic nerve axotomy and retinal ischemia have demonstrated effects due to FGF (Sievers et al., *Neurosci. Lett.* 76:157, 1987), NGF (Carmignoto et al., *J. Neurosci.* 2:1263, 1989), CNTF (Mey and Thanos, *Brain Res.* 602:304, 1993), BDNF (Mansour-Robaey et al., *PNAS USA* 91:1632, 1994; Mey and Thanos, *Brain Res.* 602:304, 1993), NT4/5 (Cohen et al., *J. Neurobiol.* 25:953, 1994) and bFGF (Ferguson et al., *J. Neurosci.* 10:2176, 1990). Some undesirable retinal complications, including macrophage proliferation, inflammation, disorganization of retinal structure and angiogenesis are associated with treatment of the retina with several of the above factors.

Neuregulins

A recently described family of growth factors, the neuregulins (reviewed, by Mudge, *Curr. Biol.* 3:361, 1993; Peles and Yarden, *Bioessays* 15:815, 1993), are synthesized by neurons (Marchionni et al. *Nature* 362:313, 1993) and by mesenchymal cells from several parenchymal organs (Meyer and Birchmeier, *PNAS* 91:1064, 1994). The neuregulins and related factors that bind $p185^{erbB}2$ have been purified, cloned and expressed (Benveniste et al. *PNAS*, 82:3930, 1985; Kimura et al., *Nature* 348:257, 1990; Davis and Stroobant, *J. Cell Biol.* 110:1353, 1990; Wen et al., *Cell* 69:559, 1992; Yarden and Ullrich, *Ann. Rev. Biochem.* 57:443, 1988; Dobashi et al., *Proc. Natl. Acad. Sci.* 88:8582, 1991; Lupu et al., *Proc. Natl. Acad. Sci.* 89:2287, 1992; Wen et al., *Mol. Cell. Biol.* 14:1909, 1994). Recombinant neuregulins have been shown to be mitogenic for peripheral glia (Marchionni et al., *Nature* 362:313, 1993) and have been shown to influence the formation of the neuromuscular junction (Falls et al., *Cell* 72:801, 1993; Jo et al., *Nature* 373: 158, 1995; Chu et al., *Cell* 14: 329, 1995).

The neuregulin gene consists of at least thirteen exons. The neuregulin transcripts are alternatively spliced and these encode many distinct peptide growth factors, which are referred to as the neuregulins (Marchionni et al., *Nature* 362:313, 1993). DNA sequence comparisons revealed that neu differentiation factor (NDF) (Wen et al., *Cell* 69:559, 1992) and heregulins (Holmes et al., *Science* 256:1205, 1992), which were purified as ligands of the $p185^{erbB}2$ (also known as neu or HER2) receptor tyrosine kinase, also are splicing variants of the neuregulin gene. The acetylcholine receptor inducing activity (ARIA) also is a product of the neuregulin gene (Falls et al., *Cell* 72:801, 1993). Common structural features of the neuregulins are the presence of a single immunoglobulin-like (Ig) fold and a single epidermal growth factor-like (EGF) domain.

The sites of neuregulin gene expression have been characterized by use of nucleic acid probes to analyze RNA samples by a variety of methods, such as Northern blotting, RNase protection, or in situ hybridization. Transcripts have been detected in the nervous system and in a variety of other tissues (Holmes et al., *Science* 256:1205, 1992 Wen et al., *Cell* 69:559, 1992; Meyer and Birchmeier, *PNAS* 91:1064, 1994). Sites of gene expression have been localized in the brain and spinal chord and in other tissues. (Orr-Urteger et al., *PNAS* 90:1.867, 1993; Falls et al., *Cell* 72:801, 1993; Marchionni et al., *Nature* 362:313, 1993; Meyer and Birchmeier, *PNAS* 91:1064, 1994; Chen et al., *J. Comp. Neurol.* 349; 389, 1994; Corfas et al., *Neuron* 14:103, 1995). Specifically in the retinal neurepithelium, expression of neuregulin transcripts has been detected at embryonic day 18 in rat (Meyer and Birchmeier, *PNAS* 91:1064, 1994).

Although a large number of neuregulins may be produced by alternative splicing, they can be broadly sorted into the putative membrane-bound and the soluble isoforms. The former contains a putative trans-membrane domain and may be presented at the cell surface. Membrane-anchored peptide growth factors may mediate cell-cell interactions through cell-adhesion or juxtacrine mechanisms (reviewed by Massagué and Pandiella, *Ann. Rev. Biochem.* 62:515, 1993). Alternatively, the putative membrane-bound isoforms may be cleaved from the cell surface and function as soluble proteins (Wen et al., *Cell* 69.559, 1992; Falls et al., *Cell* 72:801, 1993). The soluble neuregulin isoforms contain sequence corresponding to the extracellular domains of the putative membrane-bound isoforms, but terminate before the transmembrane domain. These neuregulin isoforms may be secreted, and hence could affect cells at a distance; or they may be present in the cytoplasm, but could be released upon cellular injury. In the latter case, neuregulins may function as injury factors, as has been postulated for the ciliary neurotrophic factor (Stöckli et al., *Nature* 342:920, 1989). Any one of these modes of action of the neuregulins may occur in the retina.

Cellular targets of peptide growth factors are those which bear receptors for the factor(s) and those that are shown to respond in a bioassay either in vitro or in vivo. Based on studies demonstrating phosphorylation on tyrosine residues or cross-linking experiments, neuregulins are candidate ligands for the receptor tyrosine kinases $p185^{erbB2}$ (or HER-2 in human), $p185^{erbB}3$ (HER-3 in human), $p185^{erbB}4$ (or HER-4 in human) or related members of the EGFR gene family. Collectively, these receptors can be referred to as erbB receptors. Though the precise ligand-receptor relationship of each neuregulin protein with each member of the EGFR family is yet to be clarified, several lines of evidence suggest that binding of ligands is mediated by either erbB3 and erbB4, but signaling occurs through either erbB2, erbB4 and heterodimers of the various subunits (e.g., Carraway and Cantley, *Cell* 78:5, 1994). These receptors are known to be present on Schwann cells and muscle cells (Jo et al., *Nature* 373: 158, 1995), and other neuregulin targets, such as cell lines derived from various tumor tissues, such as breast and gastric epithelia. Sites of expression of the HER-4 gene have been localized by in situ hybridization to several regions of the brain, including: hippocampus, dentate gyrus, neo cortex, medial habenula, reticular nucleus of the thalamus, and the amygdala (Lai and Lemke, *Neuron* 6:691, 1991). The distribution of the HER-4 receptor has not been studied by methods that allow detection of the protein or the activated receptor tyrosine kinase in vivo or in cultures of primary cells. The expression pattern of erbB2, erbB3 and erbB4 in the retina has not been described.

Neuregulins have been shown to have a variety of biological activities depending on the cell type being studied. Several neuregulins, including native bovine GGFI, II and III and recombinant human GGF2 (rhGGF2) are mitogenic for Schwann cells (Marchionni et al., Nature 362:313, 1993), as is heregulin B1 (Levi et al, J Neurosci. 15:1329, 1995). On human muscle culture, rhGGF2 has a potent trophic effect on 7 myotubes (Sklar et al., U.S. patent application Ser. No. 08/059, 022), filed May 6, 1993, now abandoned. The differentiation response to rhGGF2 also includes induction of acetylcholine receptors in cultured myotubes (Jo et al., Nature 373: 158, 1995). This activity is associated with other forms of neuregulin, including ARIA (Falls et al., Cell 72:801, 1993) and heregulin B1 (Chu et al., Neuron 14:329, 1995), as well as with rhGGF2. Further, ARIA has been shown to induce synthesis of voltage-gated sodium channels in chick skeletal muscle (Corfas and Fischbach, J. Neurosci. 13:2118, 1993). Glial growth factor (GGF), and more specifically rhGGF2, can restrict neural crest stem cells to differentiate into glial cells in vitro (Shah et al., Cell 77:349, 1994). Activities of neuregulin on retinal cells have not been described. In summary, there are examples of neuregulin proteins affecting proliferation, survival and differentiation of target cells.

Pharmaceutical Need for Treating Disorders of the Eye

A variety of retinal diseases and related disorders are known that produce impaired vision and in some cases progress to total blindness. These disorders of the eye include, but are not necessarily limited to: various retinopathies, such as hypertensive retinopathy, diabetic retinopathy and occlusive retinopathy; also injuries and disorders resulting in retinal degeneration, such as retinal tearing and detachment and inherited diseases, such as retinitis pigmentosa; also age-related macular degeneration; diseases of the optic nerve; glaucoma and retinal ischemia.

Diabetic Retinopathy is the leading cause of blindness in patients 25–74 years. It is responsible for 12,000–24,000 new cases of blindness per year in the United States. Of the 6 million diabetics in the US 50% show detectable retinopathy after 7 years of diabetes. Age-related macular degeneration (ARMD) is estimated to be present in over 9% of the population 52 years and older and in 33% of the population 75 years and older. Glaucoma is associated with chronically high intraocular pressure and approximately 2 million people in the US are currently being treated. In the US approximately 100,000 people are blinded each year by glaucoma.

There is precedent for the use of growth factors that have been shown to be active on retinal cultures in the treatment of retinal degenerative diseases. FGF supports the survival of photoreceptor cells in culture and has been injected into the extracellular space surrounding the rods and cones or into the vitreous body to rescue the photoreceptors in rats which have degeneration as a result of light damage or because of an inherited disease (LaVail et al, PNAS 89: 11249, 1992, Faktorovich et al J. NeuroSci 12: 3554, 1992). Similarly TGFb2 has been used for the treatment of Macular holes in humans. The TGFb used was derived from bovine sources and was administered by directly infusing the factor into the area of the macular hole (Glaser et al., Opthalmol. 99: 1162, 1992).

Currently, there are limited options for therapy for the promotion of retinal cell function, including survival, proliferation, differentiation, growth and changes in gene activity and metabolic activity. Such a therapy would be useful for treatment of a variety of eye disorders resulting in loss of sight.

SUMMARY OF THE INVENTION

In general, the present invention provides methods for promoting the function of retinal cells using neuregulins. A novel aspect of the invention involves the use of neuregulins as growth factors to promote survival of retinal cells. Treating of the retinal cells to provide these effects may, be achieved by contacting retinal cells with a polypeptide described herein. The treatments may be provided to slow or halt net cell loss or to increase the amount or quality of retinal tissue present in the vertebrate.

Neuregulins are a family of protein factors heretofore described as glial growth factors, acetylcholine receptor inducing activity (ARIA), heregulins, neu differentiation factor, which are encoded by one gene. A variety of messenger RNA splicing variants (and their resultant proteins) are derived from this gene and many of these products show binding to and activation of erbB2 (neu) and closely related receptors erbB3 and erbB4. The invention provides methods for using all of the known products of the neuregulin gene, as well as, other not yet discovered splicing variants of the neuregulin gene. Thus, the above factors, regulatory compounds that induce synthesis of these factors, and small molecules which mimic the effect of these factors by binding to the receptors on retinal tissues or by stimulating through other means the second messenger systems activated by the ligand-receptor complex are all extremely useful as prophylactic and affirmative therapies for retinal tissue diseases and related disorders of the eye.

The survival of retinal cells as used herein refers to the prevention of loss of retinal cells by necrosis or apoptosis or the prevention of other mechanisms of retinal loss. Survival as used herein indicates a decrease in the rate of cell death of at least 10%, more preferably by at least 50%, and most preferably by at least 100% relative to an untreated control. The rate of survival may be measured by counting cells stainable with a dye specific for dead cells (such as propidium iodide) in culture.

Methods for treatment of diseases or disorders using the polypeptides or other compounds described herein are also part of the invention. Examples of retinal tissue disorders that may be treated include eye diseases and disorders resulting from sensorineural pathologies, such as loss of sight, which may also be treated using the methods of the invention. These disorders of the eye include, but are not necessarily limited to: various retinopathies, such as hypertensive retinopathy, diabetic retinopathy and occlusive retinopathy; also injuries and disorders resulting in retinal degeneration, such as retinal tearing and detachment and inherited diseases, such as retinitis pigmentosa; also age-related macular degeneration; diseases of the optic nerve; glaucoma and retinal ischemia.

The methods of the invention make use of the fact that the various neuregulin proteins are encoded by the same gene. A variety of messenger RNA splicing variants (and their resultant proteins) are derived from this gene and many of these products show binding to $p185^{erbB2}$ (or related receptors erbB3 and erbB4) and activation of the same. Products of this gene are used to show retinal cell survival activity (see Example 2, below). This invention provides a use for all of the known products of the neuregulin gene (described herein and in the references listed above), which have the stated activities as promoting retinal cell function. Most preferably, recombinant human GGF2 (rhGGF2) is used in these methods.

The invention also relates to the use of other, not yet naturally isolated, splicing variants of the neuregulin gene.

FIG. 12 shows the known patterns of splicing. These patterns are derived from polymerase chain reaction experiments (on reverse transcribed RNA), analysis of cDNA clones (as presented within) and from analysis of published sequences encoding neuregulins (Peles et al., *Cell* 69:205, 1992; Wen et al., *Cell* 69:559, 1992; Wen et al., *Mol. Cell Biol.* 14:1909, 1994) These patterns, as well as additional patterns disclosed herein, represent probable splicing variants which exist. The splicing variants are fully described in Goodearl et al., U.S. Ser. No. 08/036,555, filed Mar. 24, 1993, incorporated herein by reference.

Advantages of the present invention include the development of new therapeutic approaches to injury or diseases of the eye, more specifically degenerative diseases of the retina, based on the promotion of retinal cell function through the use of neuregulins. Loss of retinal cells is a common feature of degenerative eye diseases, and there are no available treatments, including growth factors, that prevent the death of retinal ganglion cells. The factor can be formulated for intraocular injection and administered to patients that suffer from degenerative disorders, which lead to loss of sight. Thus, this approach to therapy can halt or slow the progressive loss of sight, which ensues in various eye diseases.

BRIEF DESCRIPTION OF THE FIGURES

FIG. 11A is a listing of the coding strand DNA sequence (SEQ ID NO:1) and deduced amino acid sequence (SEQ ID NO:2) of the cDNA obtained from the splicing pattern of GGFBPP1 shown in FIG. 12. Potential glycosylation sites are underlined (along with polyadenylation signal AATAAA);

FIG. 11B is a listing of the coding strand DNA sequence (SEQ ID NO:3) and deduced amino acid sequence (SEQ ID NO:4) of the cDNA obtained from splicing pattern of GGF2BPP2. Potential glycosylation sites are underlined (along with polyadenylation signal AATAAA);

FIG. 11C is a listing of the coding strand DNA sequence (SEQ ID NO:5) and deduced amino acid sequence (SEQ ID NO:6) of the cDNA obtained from splicing pattern of GGF2BPP3. Potential glycosylation sites are underlined (along with polyadenylation signal AATAAA).

FIG. 13 is a listing of the DNA sequences and predicted peptide sequences of the coding segments of GGF. Line 1 is a listing of the predicted amino acid sequences of bovine GGF, line 2 is a listing of the nucleotide sequences of bovine GGF, line 3 is a listing of the nucleotide sequences of human GGF (heregulin) (nucleotide base matches are indicated with a vertical line) and line 4 is a listing of the predicted amino acid sequences of human GGF/heregulin where it differs from the predicted bovine sequence. Coding segments E, A' and K represent only the bovine sequences. Coding segment D' represents only the human (heregulin) sequence. In particular, FIG. 13A shows the nucleotide sequences encoding the F segment of bovine and human GGF and the amino acid sequence of that region. In that Figure, line 1 is the amino acid sequence (SEQ ID NO:8), line 2 is a nucleotide sequence (SEQ ID NO:7) of bovine F segment, line 3 is a nucleotide sequence (SEQ ID NO:9) of human F segment.

FIG. 13B shows a nucleotide sequence (SEQ ID NO:10) encoding E segment of GGF and the amino acid sequence (SEQ ID NO:11) of that sequence.

FIG. 13C shows the nucleotide sequences encoding the B segment of bovine and human GGF and the amino acid sequence of that region. In that Figure, line 1 is the amino acid sequence (SEQ ID NO:13), line 2 is a nucleotide sequence (SEQ ID NO:12) of bovine B segment, line 3 is a nucleotide sequence (SEQ ID NO:14) of human B segment.

FIG. 13D shows the nucleotide sequences encoding the A segment of bovine and human GGF and the amino acid sequence of that region. In that Figure, line 1 is the amino acid sequence (SEQ ID NO:16), line 2 is a nucleotide sequence (SEQ ID NO:15) of bovine A segment, line 3 is a nucleotide sequence (SEQ ID NO:17) of human A segment.

FIG. 13E shows the nucleotide sequence (SEQ ID NO:18) encoding the A' segment of GGF and the amino acid sequence (SEQ ID NO:19) of that region.

FIG. 13F shows the nucleotide sequences encoding the G segment of bovine and human GGF and the amino acid sequence of that region. In that Figure, line 1 is the amino acid sequence (SEQ ID NO:21), line 2 is a nucleotide sequence (SEQ ID NO:20) of bovine G segment, line 3 is a nucleotide sequence (SEQ ID NO:22) of human G segment.

FIG. 13G shows the nucleotide sequences encoding the C segment of bovine and human GGF and the amino acid sequence of that region. In that Figure, line 1 is the amino acid sequence (SEQ ID NO:24), line 2 is a nucleotide sequence (SEQ ID NO:23) of bovine C segment, line 3 is a nucleotide sequence (SEQ ID NO:25) of human C segment.

FIG. 13H shows the nucleotide sequences encoding the C/D segment of bovine and human GGF and the amino acid sequence of that region. In that Figure, line 1 is the amino acid sequence (SEQ ID NO:27), line 2 is a nucleotide sequence (SEQ ID NO:26) of bovine C/D segment, line 3 is a nucleotide sequence (SEQ ID NO:28) of human C/D segment.

FIG. 13I shows the nucleotide sequences encoding the C/D' segment of bovine and human GGF and the amino acid sequence of that region. In that Figure, line 1 is the amino acid sequence (SEQ ID NO:30), line 2 is a nucleotide sequence (SEQ ID NO:29) of bovine C/D' segment, line 3 is a nucleotide sequence (SEQ ID NO:31) of human C/D' segment.

FIG. 13J shows the nucleotide sequences encoding the D segment of bovine and human GGF and the amino acid sequence of that region. In that Figure, line 1 is the amino acid sequence (SEQ ID NO:33), line 2 is a nucleotide sequence (SEQ ID NO:32) of bovine D segment, line 3 is a nucleotide sequence (SEQ ID NO:34) of human D segment.

FIG. 13K shows the nucleotide sequence (SEQ ID NO:34) encoding the D' segment of GGF and the amino acid sequence (SEQ ID NO:35) of that region.

FIG. 13L shows the nucleotide sequences encoding the H segment of bovine and human GGF and the amino acid sequence of that region. In that Figure, line 1 is the amino acid sequence (SEQ ID NO:37), line 2 is a nucleotide sequence (SEQ ID NO:36) of bovine H segment, line 3 is a nucleotide sequence (SEQ ID NO:38) of human H segment.

FIG. 13M shows the nucleotide sequence (SEQ ID NO:39) encoding the K segment of GGF and the amino acid sequence (SEQ ID NO:40) of that region.

FIG. 13N shows the nucleotide sequences encoding the L segment of bovine and human GGF and the amino acid sequence of that region. In that Figure, line 1 is the amino acid sequence (SEQ ID NO:42), line 2 is a nucleotide sequence (SEQ ID NO:41) of bovine L segment, line 3 is a nucleotide sequence (SEQ ID NO:43) of human H segment.

FIG. 13O shows the nucleotide sequence (SEQ ID NO:44) encoding the E segment of GGF and the amino acid sequence (SEQ ID NO:45) of that region.

FIGS. 14A–B is the predicted GGF2 amino acid sequence and nucleotide sequence of BPP5. The upper line is the nucleotide sequence (SEQ ID NO:46) and the lower line is the predicted amino acid sequence (SEQ ID NO:47).

FIGS. 15A–B is the predicted amino acid sequence and nucleotide sequence of GGF2BPP2. The upper line is the nucleotide sequence (SEQ ID NO:48) and the lower line is the predicted amino acid sequence (SEQ ID NO:49).

FIGS. 16A–B is the predicted amino acid sequence and nucleotide sequence of GGF2BPP4. The upper line is the nucleotide sequence (SEQ ID NO:50) and the lower line is the predicted amino acid sequence (SEQ ID NO:51).

Figure 17A:
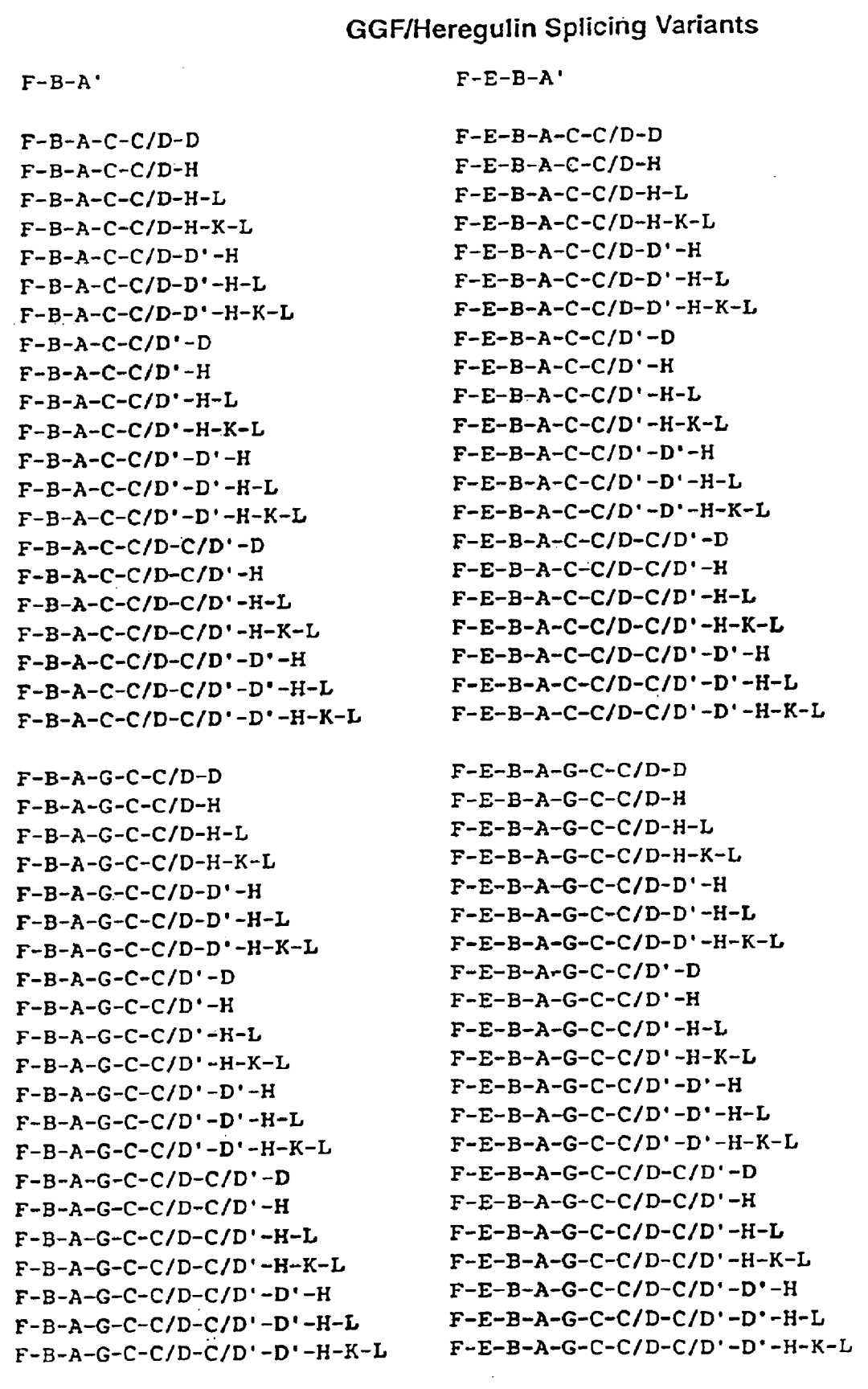
Figure 17B:
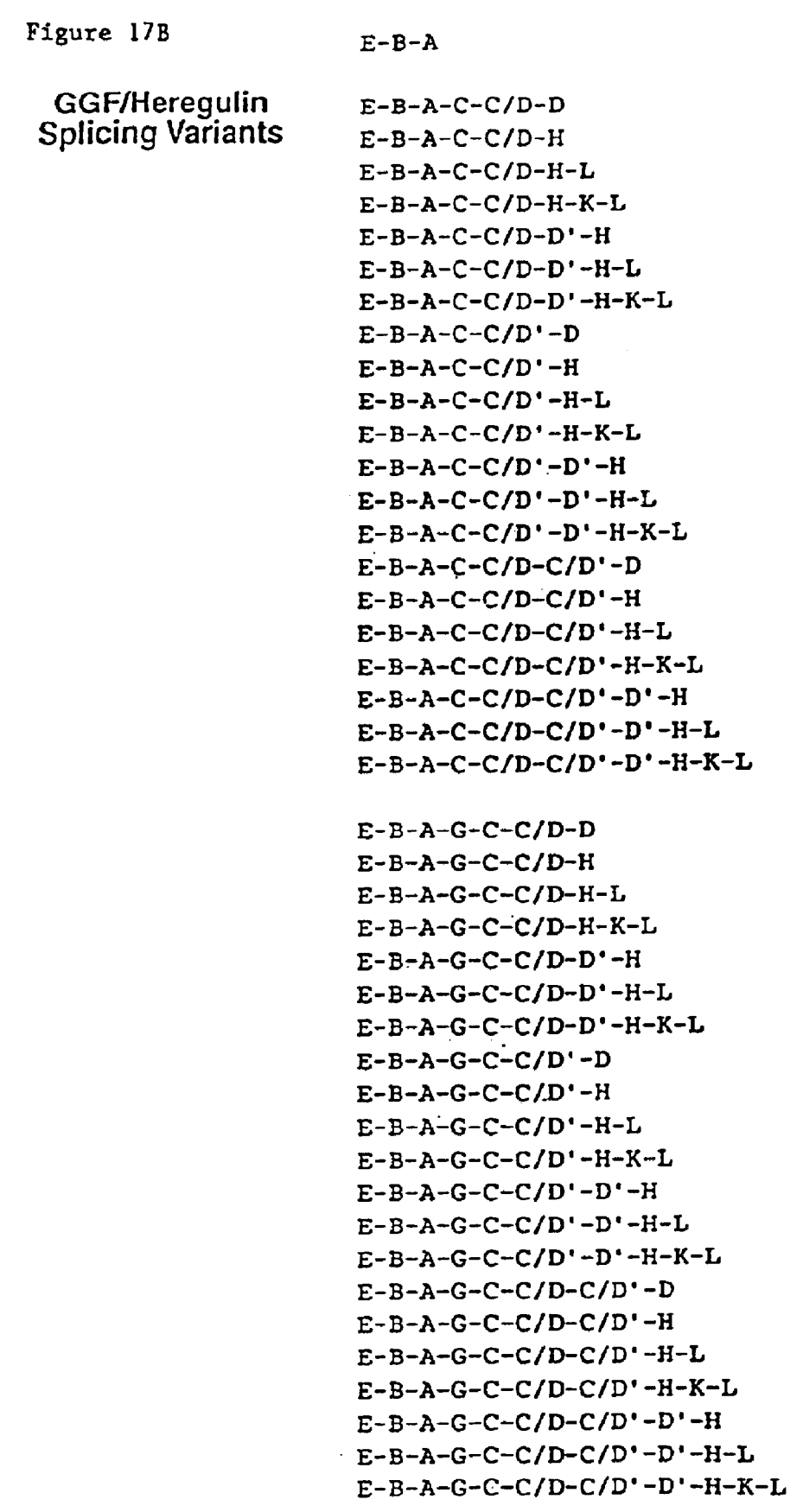

FIGS. 17A–B is a list of splicing variants derived from the sequences shown in FIG. 13.

FIG. 18 is the predicted amino acid sequence (SEQ ID NO:53), bottom, and nucleic sequence (SEQ ID NO:52), top, of EGFL1.

FIG. 19 is the predicted amino acid sequence (SEQ ID NO:55), bottom, and nucleic sequence (SEQ ID NO:54), top, of EGFL2.

FIG. 20 is the predicted amino acid sequence (SEQ ID NO:57), bottom, and nucleic sequence (SEQ ID NO:56), top, of EGFL3.

FIG. 21 is the predicted amino acid sequence (SEQ ID NO:59), bottom, and nucleic sequence (SEQ ID NO:58), top, of EGFL4.

FIG. 22 is the predicted amino acid sequence (SEQ ID NO:61), bottom, and nucleic sequence (SEQ ID NO:60), top, of EGFL5.

FIG. 23 is the predicted amino acid sequence (SEQ ID NO:63), bottom, and nucleic sequence (SEQ ID NO:62), top, of EGFL6.

FIGS. 24A–D is the predicted amino acid sequence (SEQ ID NO:65) (middle) and nucleic sequence (SEQ ID NO:64) (top) of GGF2HBS5. The bottom (intermittent) sequence represents peptide sequences derived from GGF-II preparations.

FIG. 25 is the sequences of GGFHBS5 (SEQ ID NO:66), GGFHB1 (SEQ ID NO:67) and GGFBPP5 (SEQ ID NO:68) polypeptides.

FIG. 26 is the amino acid sequence of (SEQ ID NO:69) cDNA encoding mature hGGF2.

FIG. 27 depicts a stretch of the putative bovine GGF-II gene sequence (SEQ ID NO:70) from the recombinant bovine genomic phage GGF2BG1. The figure is the coding strand of the DNA sequence and the deduced amino acid sequence in the third reading frame.

DETAILED DESCRIPTION OF THE INVENTION

Figure 1:
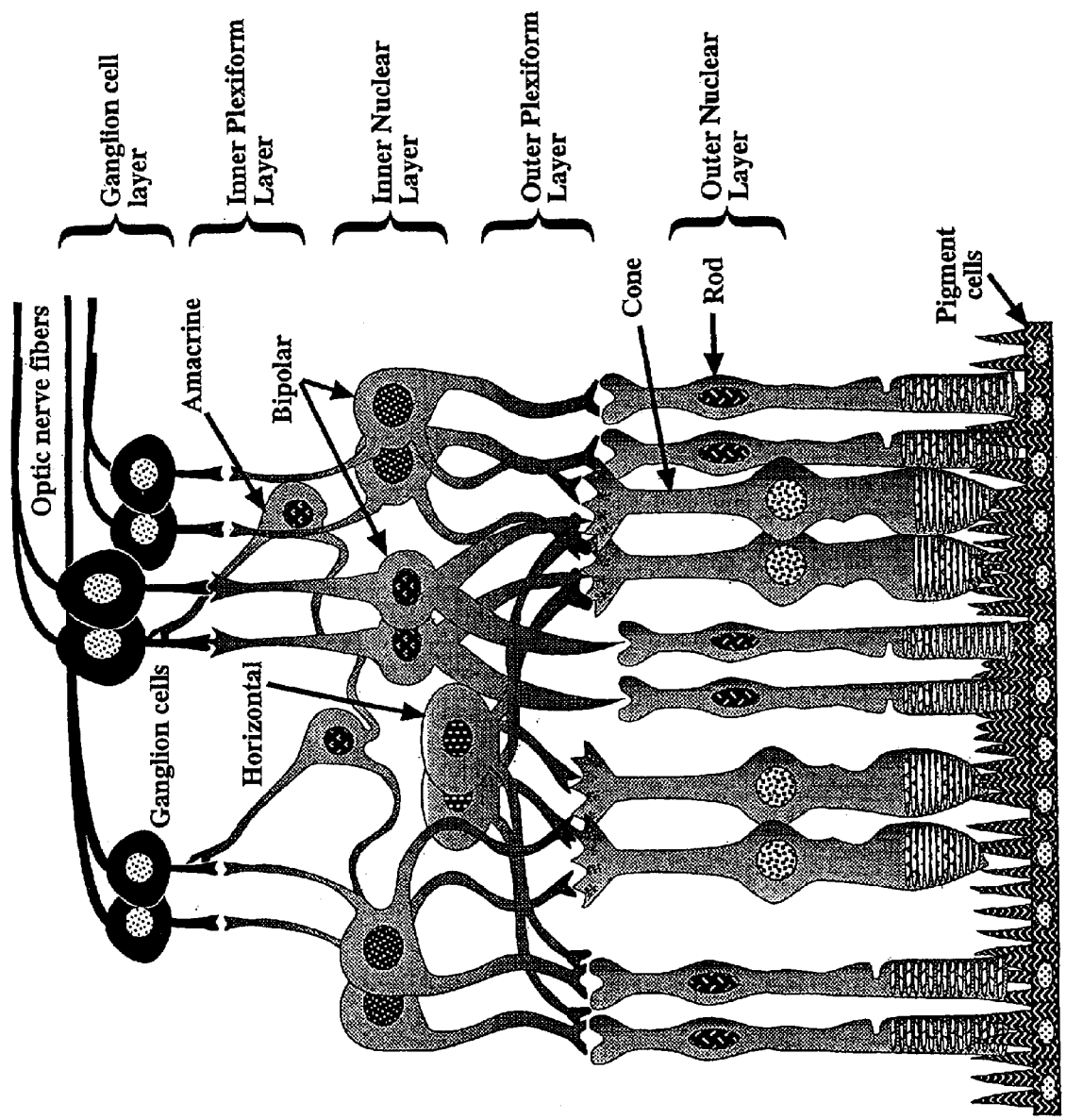
FIG. 1 shows the series of layers and cell types which form the retina.

It is intended that all references cited shall be incorporated herein by reference.

General

The invention pertains to methods of promoting function of retinal cells. The function is affected by the administration of a neuregulin to a vertebrate where the neuregulin interacts with a retinal cell to promote one or more aspects of retinal cell function, including proliferation, differentiation, growth, survival, changes in the pattern of gene expression and secretion, and metabolic change of the retinal cell.

Definition of Key Terms

The term administration as used herein refers to the act of delivering a substance, including but not limited to the following routes: parenteral, intravenous, subcutaneous, intramuscular, intraorbital, ophthalmic, intravitreal, subretinal, intraperitoneal, topical, intranasal, aerosol or oral.

The term affecting as used herein refers to the induction of a quantitative change in the response of a target cell, as a result of an interaction with a neuregulin.

The term amacrine cell as used herein refers to local interneurons in the inner plexiform layer of the retina that mediate interactions between bipolar and ganglion cells.

The term bipolar cell as used herein refers to the interneurons of the retina that connect the photoreceptor cells with the retinal ganglion cells.

The term differentiation as used herein refers to a morphological and/or chemical change that results in the generation of a different cell type or state of specialization. The differentiation of cells as used herein refers to the induction of a cellular developmental program which specifies one or more components of a cell type. The therapeutic usefulness of differentiation can be seen, in increases in quantity of any component of a cell type in diseased tissue by at least 10% or more, more preferably by 50% or more, and most preferably by more than 100% relative to the equivalent tissue in a similarly treated control animal.

The term disorder as used herein refers to a disturbance of function and/or structure of a living organism, resulting from an external source, a genetic predisposition, a physical or chemical trauma, or a combination of the above, including but not limited to any mammalian disease.

The term erbB receptor as used herein refers to erbB2, erbB3 and erbB4 (also HER-2, HER-3 and HER-4 of human) existing as monomeric, homodimeric and heterodimeric (e.g., erbB2/erbB3) cell surface receptor tyrosine kinases that bind and/or are activated by one or more neuregulins.

The term function as used herein refers to any activity or response of a cell. These include but are not limited to proliferation, differentiation, growth, survival, changes in the pattern of gene expression and secretion, and metabolic changes.

The term horizontal cell used herein refers to local interneurons in the outer plexiform layer of the retina that mediate interactions between bipolar and receptors cells.

The term mammal as used herein describes a member of the Class Mammalia (Subphylum Vertebrata).

The term mitosis as used herein refers to the division of a cell where each daughter nucleus receives identical complements of the numbers of chromosomes characteristic of the somatic cells of the species. Mitosis as used herein refers to any cell division which results in the production of new cells in the patient. More specifically, a useful therapeutic is defined in vitro as an increase in mitotic index relative to untreated cells of 50%, more preferably 100%, and most preferably 300%, when the cells are exposed to labeling agent for a time equivalent to two doubling times. The mitotic index is the fraction of cells in the culture which have labeled nuclei when grown in the presence of a tracer which only incorporates during S phase (i.e., BrdU) and the doubling time is defined as the average time required for the number of cells in the culture to increase by a factor of two.

The term neuregulin as used herein refers to the glial growth factors, the heregulins, neu differentiation factor, acetylcholine receptor inducing activity, and erbB2, 3 and 4 binding proteins. A more complete definition of neuregulins can be found in the specification herein and in the following materials: U.S. Pat. No. 5,237,056; U.S. Pat. No. 5,716,930; WO 92/20798; EPO 0 505 148 A1; Marchionni, et al., *Nature* 362:313, 1993; Benveniste, et al., *PNAS* 82:3930, 1985; Kimura, et al., *Nature* 348:257, 1990; Davis and Stroobant, *J. Cell. Biol.* 110:1353, 1990; Wen, et al., *Cell* 69:559, 1992; Yarden and Ullrich, *Ann. Rev. Biochem.* 57:443, 1988; Holmes, et al., *Science* 256:1205, 1992; Dobashi, et al., *Proc. Natl. Acad. Sci.* 88:8582, 1991; Lupu, et al., *Proc. Natl. Acad. Sci.* 89:2287, 1992; Peles and Yarden, *BioEssays* 15:815, 1993, Mudge, *Current Biology* 3:361, 1993, all hereby incorporated by reference.

The term neurological disorder as described herein refers to a disorder of the nervous system.

The term photoreceptor cell as used herein refers to two retinal cell types, rods and cones, that are the cells that transduce light into an electrical signal.

The term retinal cell as used herein refers to any of the cell types that comprise the retina, such as retinal ganglion cells, amacrine cells, horizontal cells, bipolar cells, and photoreceptor cells including rods and cones, Müller glial cells and retinal pigmented epithelium.

The term retinal ganglion cell as used herein refers to neurons of the retina that project axons via the optic nerve to the lateral geniculate nucleus and the superior colliculus.

The term survival as used herein refers to any process where a cell avoids death. The term survival as used herein also refers to the prevention of cell loss as evidenced by necrosis or apoptosis or the prevention of other mechanisms of cell loss. Survival as used herein indicates a decrease in the rate of cell death by at least 10%, more preferably by at least 50%, and most preferably by at least 100% relative to an untreated control. The rate of survival may be measured by counting cells stainable with a dye specific for dead cells (such as propidium iodide) in culture.

The term therapeutically effective amount as used herein refers to that amount which will produce a desirable result upon administration and which will vary depending upon a number of issues, including the dosage to be administered, and the route of administration.

The term treating as used herein may refer to a procedure (e.g. medical procedure) designed to exert a beneficial effect on a disorder. Treating as used herein means any administration of a substance described herein for the purpose of increasing retinal cell function. Most preferably, the treating is for the purpose of reducing or diminishing the symptoms or progression of a disease or disorder of retinal cells. Treating as used herein also means the administration of a substance to increase or alter the cells in healthy individuals. The treating may be brought about by the contacting of the cells which are sensitive or responsive to the neuregulins described herein with an effective amount of the neuregulin.

The term TUJ1 as used herein refers to an antibody that recognizes a neural-specific form of β-tubulin, which is expressed in the longitudinal cells, amacrine cells and ganglion cells of the retina.

The term vertebrate as used herein refers to an animal that is a member of the Subphylum Vertebrata (Phylum Chordata).

Neuregulins

A novel aspect of the present invention relates to the ability of neuregulins to affect retinal cell function. Neuregulins are the products of a gene which produce a number of variably-sized, differentially-spliced RNA transcripts that give rise to a series of proteins. These proteins are of different lengths and contain some common peptide sequences and some unique peptide sequences. The conclusion that these factors are encoded by a single gene is supported by the differentially-spliced RNA sequences which are recoverable from bovine posterior pituitary, human spinal chord and human breast cancer cells (MDA-MB-231). Further support for this conclusion derives from the size range of proteins which act as ligands for the erbB receptors (see below).

Further evidence to support the fact a single gene encodes the various neuregulins derives from nucleotide sequence comparisons. Holmes et al., (*Science* 256:1205, 1992) demonstrate the purification of a 45-kilodalton human protein (Heregulin-a) which specifically interacts with the receptor protein p185$^{erbB2}$. Peles et al., (*Cell* 69:559, 1992) describe a complementary DNA isolated from rat cells encoding a protein call "neu differentiation factor" (NDF). The translation product of the NDF cDNA has p185$^{erbB2}$ binding activity. Several other groups have reported the purification of proteins of various molecular weights with erbB receptor binding activity. These groups include the following: Lupu et al., *Proc. Natl. Acad. Sci. USA* 89:2287, 1992; Yarden and Peles, *Biochemistry* 30:3543, 1991; Lupu et al., *Science* 249:1552, 1990; Dobashi et al., *Biochem. Biophys. Res. Comm.* 179:1536, 1991; and Huang et al., *J. Biol. Chem.* 257:11508, 1992.

We have found that proteins that bind p185$^{erbB2}$ and related receptors (i.e., p185$^{erbB3}$ and p185$^{erbB4}$) affect retinal cell survival (Example 2). Further, the presence of immunologically-detectable neuregulin protein (Example 1) in retinal ganglion cells in vivo indicates that neuregulin has a role in retinal cell survival in vivo.

These neuregulins may be identified using the protocols described herein and in Holmes et al., *Science* 256: 1205, 1992; Peles et al., *Cell* 69:205, 1992; Wen et al., *Cell* 69:559, 1992; Lupu et al., *Proc. Natl. Acad. Sci. USA* 89:2287, 1992; Yarden and Peles, *Biochemistry* 30:3543, 1991; Lupu et al., *Science* 249:1552, 1990; Dobashi et al., *Biochem. Biophys. Res. Comm.* 179:1536, 1991; Huang et al., *J. Biol. Chem.* 257:11508–11512, 1992; Marchionni et al., *Nature* 362:313, 1993; and in U.S. patent application Ser. No. 07/931,041, filed Aug. 17, 1992, now abandoned, all of which are incorporated herein by reference.

Specifically, the invention provides for use of polypeptides of a specified formula, and DNA sequences encoding those polypeptides. The polypeptides have the formula WYBAZCX (SEQ ID NOs: 138–305)

wherein WYBAZCX is composed of the polypeptide segments shown in FIG. 13; wherein W comprises the polypeptide segment F, or is absent; wherein Y comprises the polypeptide segment E, or is absent; wherein Z comprises the polypeptide segment G or is absent; and wherein X comprises the polypeptide segments C/D HKL, C/D H, C/D HL, C/DD, C/D, C/D' HL, C/D' HKL, C/D' D, C/D C/D' HKL, C/D C/D' H, C/D C/D' HL, C/D C/D' D, C/D D' H, C/D D' HL, C/D D' HKL, C/D D' H, C/D' D' HL , C/D' D' HKL, C/D C/D' D' D' H, C/D C/D' D' HL, or C/D C/D' D' HKL (SEQ ID NOs: 309–329, respectively); provided that, either a) Y comprises the polypeptide segment E; or b) X comprises the polypeptide segments C/D HKL, C/D D, C/D' HKL, C/D C/D' HKL, C/D C/D' D, C/D D' H, C/D D' HL, C/D D' HKL, C/D' D' H, C/D' D' HKL, C/D' D' H, C/D CD/' D' HL, C/D C/D' D' HKL, C/D' H, C/D C/D' H, or C/D C/D' HL.

In addition, the invention includes the use of the DNA sequence comprising coding segments $^5$'FBA$^{3'}$ as well as the with corresponding polypeptide segments having the amino acid sequences shown in FIG. 13;

the DNA sequence comprising the coding segments $^5$'FBA$^{'3'}$ as well as the corresponding polypeptide segments having the amino acid sequences shown in FIG. 13;

the DNA sequence comprising the coding segments $^5$'FEBA$^{3'}$ as well as the corresponding polypeptide segments having the amino acid sequences shown in FIG. 13;

the DNA sequence comprising the coding segments $^5$'FEBA$^{'3'}$ as well as the corresponding polypeptide segments having the amino acid sequences shown in FIG. 13;

the DNA sequence comprising the polypeptide coding segments of the GGF2HBS5 cDNA clone (ATCC Deposit No. 75298, deposited Sep. 2, 1992), also known as GGF-II.

The invention further includes the use of peptides of the formula FBA, FEBA, FBA' FEBA' and DNA sequences encoding these peptides wherein the polypeptide segments correspond to amino acid sequences shown in FIG. 13. The polypeptide purified GGF-II polypeptide is also included as part of the invention.

Also included in this invention is the mature GGF peptide and the DNA encoding said peptide, exclusive of the N-terminal signal sequence, which is also useful for treatment of conditions involving abnormalities in retinal cell function.

Furthermore, the invention includes a method of retinal cell function by, the application to a vertebrate of a 30 kD polypeptide factor isolated from the MDA—MB 231 human breast cell line; or 35 kD polypeptide factor isolated from the rat I-EJ transformed fibroblast-cell line to the glial cell; or 75 kD polypeptide factor isolated from the SKBR-3 human breast cell line; or 44 kD polypeptide factor isolated from the rat I-EJ transformed fibroblast cell line, or 25 kD polypeptide factor isolated from activated mouse peritoneal macrophages; or 45 kD polypeptide factor isolated from the MDA-MB 231 human breast cell; or 7 to 14 kD polypeptide factor isolated from the ATL-2 human T-cell line to the glial cell; or 25 kD polypeptide factor isolated from the bovine kidney cell; or 42 kD polypeptide factor (ARIA) isolated from brains.

The invention further includes a method for the use of the EGFL1, EGFL2, EGFL3, EGFL4, EGFL5, and EGFL6 polypeptides, FIGS. 18 to 23 and respectively; for the methods of affecting retinal cell function in vivo and in vitro.

Also included in the invention is the administration of the GGF-II polypeptide whose sequence is shown in FIG. 24 for affecting retinal cell function.

Thus, the invention further embraces a polypeptide factor capable of affecting retinal cell function and including an amino acid sequence encoded by:

(a) a DNA sequence shown in FIG. 11;

(b) a DNA sequence shown in FIG. 27;

(c) the DNA sequence represented by nucleotides 281–557 of the sequences shown in FIG. 11; or (d) a DNA sequence hybridizable to any one of the DNA sequences according to (a), (b) or (c).

The invention further includes sequences which have greater than 60%, preferably 80%, sequence identity of homology to the sequences indicated above.

While the present invention is not limited to a particular set of hybridization conditions, the following protocol gives general guidance which may, if desired, be followed:

DNA probes may be labeled to high specific activity (approximately $10^8$ to $10^9$ $^{32}$P dpm/µg) by nick-translation or by PCR reactions according to Schowalter and Sommer (*Anal. Biochem.* 177:90, 1989) and purified by desalting on G-150 Sephadex columns. Probes may be denatured (10 minutes in boiling water followed by immersion into ice water), then added to hybridization solutions of 80% buffer B (2 g polyvinylpyrolidine, 2 g Ficoll-400, 2 g bovine serum albumin, 50 ml 1 M Tris HCL (pH 7.5), 58 g NaCl, 1 g sodium pyrophosphate, 10 g sodium dodecyl sulfate, 950 ml $H_2O$) containing 10% dextran sulfate at $10^6$ dpm $^{32}$P per ml and incubated overnight (approximately 16 hours) at 60° C. The filters may then be washed at 60° C. first in buffer B for 15 minutes followed by three 20-minute washes in 2×SSC, 0.1% SDS then one for 20 minutes in 1×SSC, 0.1% SDS.

In other respects, the invention provides:

(a) a basic polypeptide factor which has, if obtained from bovine pituitary material, an observed molecular weight, whether in reducing conditions or not, of from about 30 kD to about 36 kD on SDS-polyacrylamide gel electrophoresis using the following molecular weight standards:

| | |
|---|---|
| Lysozyme (hen egg white) | 14,400 |
| Soybean trypsin inhibitor | 21,500 |

-continued

| | |
|---|---|
| Carbonic anhydrase (bovine) | 31,000 |
| Ovalbumin (hen egg white) | 45,000 |
| Bovine serum albumin | 66,200 |
| Phosphorylase B (rabbit muscle) | 97,400; | which factor has glial cell mitogenic activity including stimulating the division of rat Schwann cells in the presence of fetal calf plasma, and when isolated using reversed-phase HPLC retains at least 50% of said activity after 10 weeks incubation in 0.1% trifluoroacetic acid at 4° C.; and (b) a basic polypeptide factor which has, if obtained from bovine pituitary material, an observed molecular weight, under non-reducing conditions, or from about 55 kD to about 63 kD on SDS-polyacrylamide gel electrophoresis using the following molecular weight standards:

| | |
|---|---|
| Lysozyme (hen egg white) | 14,400 |
| Soybean trypsin inhibitor | 21,500 |
| Carbonic anhydrase (bovine) | 31,000 |
| Ovalbumin (hen egg white) | 45,000 |
| Bovine serum albumin | 66,200 |
| Phosphorylase B (rabbit muscle) | 97,400; | which factor the human equivalent of which is encoded by DNA clone GGF2HBS5 described herein and is capable of affecting retinal cell function.

For convenience of description only, the lower molecular weight and higher molecular weight factors of this invention are referred to hereafter as "GGF-I" and "GGF-II", respectively. The "GGF2" designation is used for all clones isolated with peptide sequence data derived from GGF-II protein (i.e., GGF2HBS5, GGF2BPP3).

It will be appreciated that the molecular weight range limits quoted are not exact, but are subject to slight variations depending upon the source of the particular polypeptide factor. A variation of, say, about 10% would not, for example, be impossible for material from another source.

Another important aspect of the invention is a DNA sequence encoding a polypeptide capable of affecting retinal cell function and comprising:

(a) a DNA sequence shown FIG. 11;
(b) a DNA sequence shown in FIG. 27;
(c) the DNA sequence represented by nucleotides 281–557 of the sequence shown in FIG. 11; or
(d) a DNA sequence hybridizable to any one of the DNA sequences according to (a), (b) or (c).

Thus other important aspects of the invention are:

(a) A series of human and bovine polypeptide factors capable of affecting retinal cell function. These peptide sequences are shown in FIGS. 13, 14, 15 and 16 respectively.
(b) A series of polypeptide factors capable of affecting retinal cell function and purified and characterized according to the procedures outlined by Lupu et al., Science 249:1552, 1990; Lupu et al., Proc. Natl. Acad. Sci USA 89: 2287, 1992; Holmes et al., Science 256:1205, 1992; Peles et al., Cell 69:205, 1992; Yarden and Peles, Biochemistry 30:3543, 1991; Dobashi et al., Proc. Natl. Acad. Sci. 88: 8582, 1991; Davis et al., Biochem. Biophys. Res. Commun. 179:1536, 1991; Beaumont et al., Patent Application PCT/US91/03443 (1990); Greene et al., Patent Application PCT/US91/ 02331 (1990); Usdin and Fischbach, J. Cell. Biol. 103:493, 1986; Falls et al., Cold Spring Harbor Symp. Quant. Biol. 55:397, 1990; Harris et al., Proc. Natl. Acad. Sci. USA 88:7664, 1991; and Falls et al., Cell 72:801, 1993.
(c) A polypeptide factor (GGFBPP5) is capable of affecting retinal cell function. The amino acid sequence is shown in FIG. 14, and is encoded by the bovine DNA sequence shown in FIG. 14.

The novel human peptide sequences described above and presented FIGS. 13, 14, 15, and 16, respectively, represent a series of splicing variants which can be isolated as full length complementary DNAs (cDNAs) from natural sources (cDNA libraries prepared from the appropriate tissues) or can be assembled as DNA constructs with individual exons (e.g., derived as separate exons) by someone skilled in the art.

Other compounds, in particular peptides, which bind specifically to erbB receptors can also be used according to the invention as effectors of retinal cell function. A candidate compound can be routinely screened for erbB receptor binding, and, if it binds, can then be screened for affecting retinal cell function, more specifically, retinal cell survival, using the methods described herein.

The invention includes any modifications or equivalents of the above polypeptide factors which do not exhibit a significantly reduced activity. For example, modifications in which amino acid content or sequence is altered without substantially adversely affecting activity are included. By way of illustration, in EP-A 109748 mutations of native proteins are disclosed in which the possibility of unwanted disulfide bonding is avoided by replacing any cysteine in the native sequence which is not necessary for biological activity with a neutral amino acid. The statements of effect and use contained herein are therefore to be construed accordingly, with such uses and effects employing modified or equivalent factors being part of the invention.

The new sequences of the invention open up the benefits of recombinant technology. The invention thus also includes the following aspects:

(a) DNA constructs comprising DNA sequences as defined above in operable reading frame position within vectors (positioned relative to control sequences so as to permit expression of the sequences) in chosen host cells after transformation thereof by the constructs (preferably the control sequence includes regulatable promoters, e.g. Trp). It will be appreciated that the selection of a promoter and regulatory sequences (if any) are matters of choice for those of skill in the art:
(b) host cells modified by incorporating constructs as defined in (a) immediately above so that said DNA sequences may be expressed in said host cells—the choice of host is not critical, and chosen cells may be prokaryotic or eukaryotic and may be genetically modified to incorporate said constructs by methods known in the art; and,
(c) a process for the preparation of factors as defined above comprising cultivating the modified host cells under conditions permitting expression of the DNA sequences. These conditions can be readily determined, for any particular embodiment, by those of skill in the art of recombinant DNA technology. Glial cell mitogens prepared by this means are included in the present invention.

None of the factors described in the art has the combination of characteristics possessed by the present new polypeptide factors.

The invention also includes a neuregulin as defined above, by extracting vertebrate brain material to obtain protein, subjecting the resulting extract to chromatographic purification by hydroxyapatite HPLC and then subjecting these fractions to SDS-polyacrylamide gel electrophoresis. The fraction which as an observed molecular weight of about 30 kD to 36 kD and/or the fraction which has an observed molecular weight of about 55 kD to 63 kD is collected. In either case, the fraction is subjected to SDS-polyacrylamide gel electrophoresis using the following molecular weight standards:

| | |
|---|---|
| Lysozyme (hen egg white) | 14,400 |
| Soybean trypsin inhibitor | 21,500 |
| Carbonic anhydrase (bovine) | 31,000 |
| Ovalbumin (hen egg white) | 45,000 |
| Bovine serum albumin | 66,200 |
| Phosphorylase B (rabbit muscle) | 97,400 |

In the case of the smaller molecular weight fraction, the SDS-polyacrylamide gel is run in non-reducing conditions in reducing conditions or, and in the case of the larger molecular weight fraction the gel is run under non-reducing conditions. The fractions are then tested for activity stimulating the division of rat Schwann cells against a background of fetal calf plasma.

Preferably, the above, process starts by isolating a relevant fraction obtained by carboxymethyl cellulose chromatography, e.g. from bovine pituitary material. It is also preferred that hydroxyapatite HPLC, cation exchange chromatography, gel filtration, and/or reversed-phase HPLC be employed prior to the SDS-Polyacrylamide gel electrophoresis. At each stage in the process, activity may be determined using Schwann cell incorporation of radioactive iododeoxyuridine as a measure in an assay generally as described by Brockes in *Meth. Enz.* 147:217, 1987, but modified by substituting 10% FCP for 10% FCS.

Compounds can be assayed for their usefulness in vitro using the methods provided in the description and examples below. Following the in vitro demonstration of the effect of neuregulins on retinal cell function, the in vivo therapeutic benefit of the effect can be accomplished by the administration of neuregulins, neuregulin producing cells or DNA encoding neuregulins to a vertebrate requiring therapy.

In Vitro Assays of Neuregulin Effects on Retinal Cells

Several in vitro assays are used to determine which neuregulin protein(s) promote retinal cell function and which retinal cell types are affected by contacting neuregulin protein. Described below are methods for detecting the ability of a neuregulin to promote function of a retinal cell. In vitro assays for determining neuregulin effects on retinal cell function depend on establishing retinal cultures. A general reference on cell and tissue culture is *Cell and Tissue Culture: Laboratory Procedures* (Ed. by A. Doyle, J. B. Griffiths, and D. G. Newell, John Wiley and Sons, New York, N.Y., 1994). General references on the culture of neural cells and tissues are *Methods in Neurosciences*, Vol. 2 (Ed. by P. M. Conn. Academic Press, Sand Diego, Calif., 1990) and *Culturing Nerve Cells* (Ed. by G. Banker and K. Goslin, MIT Press, Cambridge, Mass., 1991). General references of immunocytochemistry are *Antibodies: A Laboratory Manual* (E. Harlow and D. Lane, Cold Spring Harbor Laboratory, Cold Spring Harbor, N.Y., 1988), and *Immunocytochemistry II* (Ed. by A. C. Cuello, John Wiley and Sons, New York, N.Y., 1993).

The retinal cells from a vertebrate used in this invention may be cultured in a variety of media. Commercially available media such as Ham's F10(Sigma), Minimal Essential Medium ([MEM], Sigma), RPMI-1640 (Sigma), and Dulbecco's Modified Eagle's Medium ([DMEM], Sigma) are suitable for culturing retinal cells. In addition, any of the media described in Ham and Wallace, *Meth. Enz.* 58:44, 1979; Barnes and Sato, *Anal. Biochem.* 102:255, 1980; U.S. Pat. Nos. 4,767,704; 4,657,866; 4,927,762; or 4,560,655; WO 90/03430; WO 87/00195 and U.S. Pat. No. Re. 30,985, may be used as culture media for retinal cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleosides (such as adenosine and thymidine), antibiotics (such as Gentamycin™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, will be apparent to the ordinarily skilled artisan.

The use of retinal cell cultures to demonstrate that neuregulin promotes retinal cell function is in accordance with methods described in general terms above and further described in Pittack et al., *Devel.* 113:577, 1991. The retina is dissected from either embryonic or adult vertebrate animals and placed into $Ca^{+2}/Mg^{+2}$-free Hepes-buffered sterile saline (HBSS) for 15 min., followed by treatment with 0.25% trypsin for an additional 15 min. The trypsin is inactivated by the addition of 1% fetal bovine serum. The cells are subsequently resuspended in fresh medium and gently triturated to yield a single-cell suspension. Cells are plated into wells of 24-well plates and cultured at 37° C. The types of retinal cells present in the culture can be identified through the use of immunocytochemical markers. Specific molecular markers can be stained immunocytochemically for the identification of cell types in the retina: for photoreceptors—e.g., rhodopsin, and red and green cone opsins; for amacrine cells—e.g., cellular retinoic acid binding protein;.for bipolar cells—e.g., a specific form of protein kinase C and its substrate protein PCP2; for retinal ganglion cells—Thy1 and β3-tubulin and; for horizontal cells—β3-tubulin. After maintaining the cultures for varying periods of time, preferably greater than 1 day and less than 7 days, a variety of assays can be utilized to assess various aspects of cellular phenotype such as, but not limited to, cell survival, proliferation, differentiation, morphology, and production of enzymes and secreted products.

In Vitro Method I

The survival function is assayed by methods that identify and count either viable cells or dead retinal cells following culture at low density (e.g., for retinal ganglion cells 10,000 cells/cm$^2$) over a period from one to six days in the presence of varying amounts of neuregulin added to the culture medium. Included in these methods are specific stains for dead cells, such as propidium iodide, which enters the nucleus of dead cells and is detected by fluorescence microscopy. Alternatively, the counting of retinal cells adhering to the culture substratum over a six day period also can be used as an indicator of cell survival.

In Vitro Method II

An alternative procedure to monitor retinal cell death utilizes labeling of nicked DNA strands, which are characteristic of cells undergoing apoptotic cell death, with digoxygenin-11-dUTP using terminal deoxynucleotidyl transferase (TUNEL) according to the protocol described in Gavrieli et al., *J. Cell Biol.* 119: 493–501, 1992. The labeled DNA strands are detected using standard kits available from commercial vendors (e.g., Genius kit from Boehringer Mannheim). Further, a cell death detection ELISA system, which is based on the DNA fragmentation that occurs in dying cells (Boehringer Mannheim catalog no. 1585 045) can be utilized to quantify cell death in accordance with the instructions provided by the commercial vendor.

In Vitro Method III

The release into the culture medium of the cytosolic enzyme lactate dehydrogenase (LDH) also can be used to quantify the extent of retinal cell death in vitro (Kirk et al, *J. Pharmacol. Exper. Therapeut.* 271:1080, 1994). LDH levels are measured by an automated kinetic colorimetric assay in which oxidation of lactate to pyruvate is coupled to reduction of the tetrazolium dye, INT. Briefly, 80 ul samples of the culture medium are mixed with an equal volume of the substrate solution containing (in mg/l) INT, 334; phenazine methosulfate, 86; nicotinamide adenine dinucleotide, 862; L-(+)-lactate, 4900 (lithium salt); and 0.1% Triton X-100 in 0.2 M Tris buffer, pH 8.2. In the assay, LDH activity is directly proportional to the rate of appearance of the resulting INT formazan (absorbance max. at 492 nm). The product is monitored quantitatively in a microplate reader (UVmax, Molecular Devices, Menlo Park, Calif.) as the change in absorbance at 490 nm over a 2 min. interval.

In Vitro Method IV

The proliferative function of neuregulins on retinal cells can be assayed by incorporation of $^{125}$I-Urd, $^{3}$H-dT or BrdU into replicating DNA strands of dividing cells, or by cell counting. The assays developed to measure the mitogenic activity of neuregulins on Schwann cells by incorporation of DNA synthesis precursors (Brockes et al., *Brain Res.* 165:105, 1979; Davis and Stroobant, *J. Cell Biol.* 110: 1353, 1990) can be adapted to retinal cells by one of normal skill in the art of cell culture.

In Vitro Method V

Figure 4:
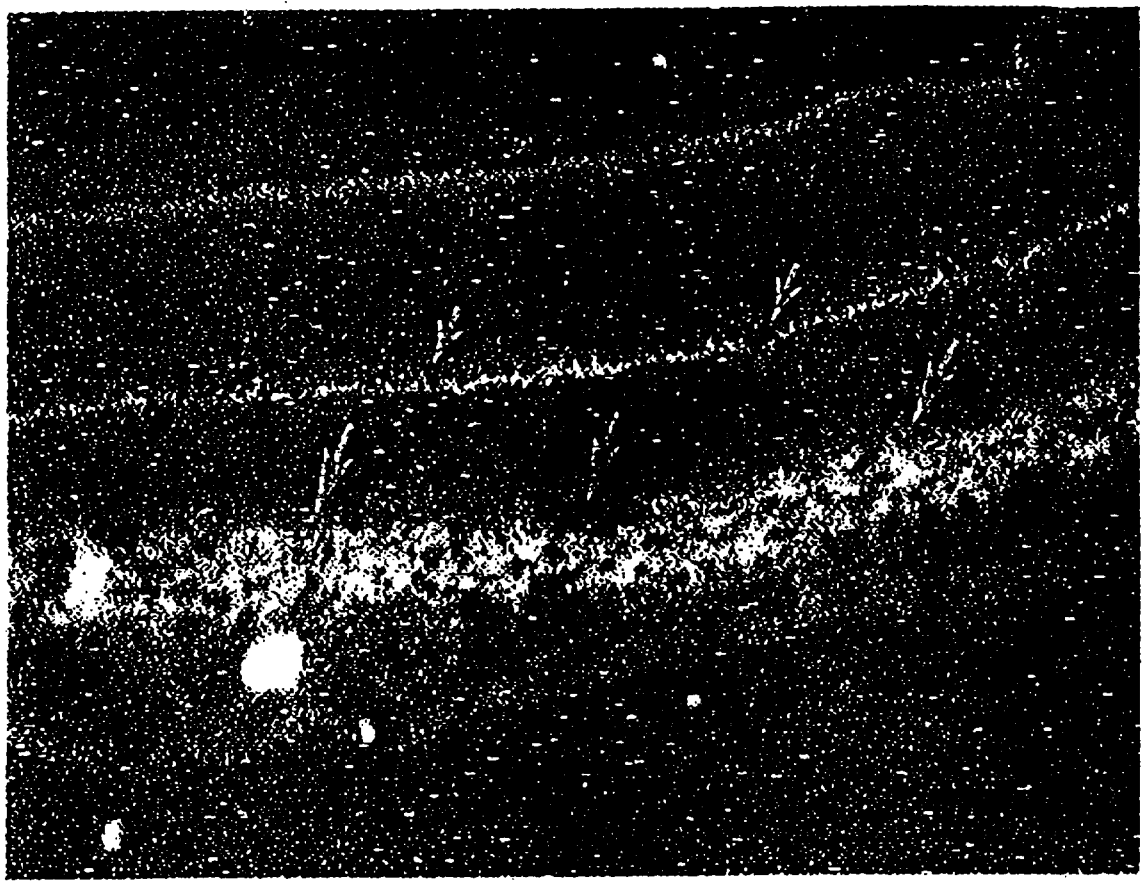
FIG. 4 is immunostaining showing that neuregulin protein is present in the inner and outer plexiform layers of the adult retina.

The differentiation function of neuregulin on retinal cells can be assayed by employing analytical methods, such as immunostaining or in situ hybridization, which can detect and quantify marker proteins associated with the various cell types of the retina. Retinal ganglion cells are recognized by staining with the specific tubulin antibody TUJ1, as shown in Example 2 (FIG. 4). The glial cells of the retina, Müller glia, are recognized by staining with antibodies that recognize glial fibrillary acidic protein (GFAP). For example, neurogenesis of retinal cells in culture can be achieved by dissociating embryonic retinal progenitor cells of the rat (from E15 through E18), then contacting the cells with the neuregulin and quantifying the distribution of various cell types identified by immunostaining using the markers described herein. In addition to this assay, which is based on determining activity in retinal neurogenesis, the differentiation function of neuregulin can be assayed in mature cultures (e.g., differentiated in culture for approximately two weeks). As such, changes in the level of specific proteins expressed in particular retinal cell types can be quantified.

In Vitro Method VI

Several peptide growth factors and their receptors have been identified in the retina, as described in the prior act. Methods utilized to detect those molecules and activities can be employed to demonstrate a differentiation function of neuregulin on retinal cells. Neuregulins can be shown to induce the synthesis of growth factors and/or their receptors expressed in the retina. The analysis can be by in situ hybridization or other methods of quantitative RNA analysis, such as, but not limited to, reverse transcription-PCR, RNAse protection and Northern blotting. Alternatively, induced expression of growth factors or their receptors can be assayed by immunocytochemical staining or cell biological assays designed to measure growth factor activity.

The in vitro assays described above to identify neuregulins that have biological activity on retinal cells can be applied to dissociated cells, semi-dissociated cells, explants of whole retina and parts thereof, such as preparations of retinal pigmented epithelium and other layers of the retina. The cultures can be established and maintained using methods described above. In some cases, minor modifications or substitutions to the procedures described herein, which do not alter the reduction to practice of, the invention, can be provided by one of ordinary skill in the art.

In Vivo Assays of Neuregulin Effects on Retinal Cells

Neuregulin activity on retinal cells also can be shown through in vivo assays. Some in vivo assays represent animal models of retinal degeneration and other diseases and disorders of the eye. For example, photoreceptor cells are lost in inherited retinal degeneration and in age-related macular degeneration. Retinal ganglion cells die in glaucoma and in optic nerve injuries, such as retinal ischemia or axotomy.

In Vivo Method I

The rescue of photoreceptor cells can be demonstrated in Royal College of Surgeons (RCS) rats, which have an inherited retinal degeneration (Faktorovich et al., *Nature* 347:83, 1990). The histological analysis (Method H1) consists of vascular perfusion of anesthetized animals, embedding the eye in epoxy resin, then staining 1 micron sections with toluidine blue. In untreated RCS rats at 53 days after birth (P53) the outer nuclear layer, which contains the photoreceptor cells, is reduced in thickness to only a few rows of cells (approximately 20% of the thickness found in normal rats at the same age). A therapeutically effective dose of neuregulin administered by intravitreal administration (a single injection of 1 microliter) can restore the thickness of the outer nuclear layer, and hence rescue photoreceptor cells. Alternatively, rescue of photoreceptor cells can be demonstrated in the Sprague-Dawley rat models (2-to-3 month old males) of exposure to constant light (115–200 foot-candles) for 1 week (LaVail et al., *PNAS USA* 89:11249, 1992). Neuregulin can be injected (1 ul) into the subretinal space or into the vitreous humor 48 hours prior to the onset of continuous illumination. Histological analysis (Method H1) of retinas following a fixed recovery period (usually 10 days) is used to assess the damage to and rescue of photoreceptor cells. Retinal detachment also leads to the death of photoreceptor cells, which provides another animal model (Erickson et al., *J. Struct. Biol.* 108:148, 1992) to demonstrate the in vivo survival activity of neuregulin on retinal cells.

In Vivo Method II

Several mouse genetic models of photoreceptor degeneration (e.g., rd—mutant of b subunit of cGMP phosphodiesterase; rds—mutant of peripherin) can be used to show neuregulin survival effects in vivo using the modes of administration described above. The rd and rds animals show retinal degeneration within a few weeks after birth and following intravitreal injection of neuregulin tissues can be analyzed by histological methods described above (e.g., Method H1). Further, retinal explants from rd mice cultured in neuregulin-containing medium can be assayed for thickness of the outer nuclear layer using methods described in Caffe et al., *Curr. Eye Res.* 12:719, 1993. Mouse pups are enucleated 48 hours after birth and treated with proteinase K. After enzyme treatment, the neural retina with the retinal pigmented epithelium (RPE) attached is recovered, placed into a multi-well culture dish and incubated in 1.2 ml culture medium (e.g., R16) for up to 4 weeks at 37° C. with 5% $CO_2$. Immunocytochemical staining for opsin of fixed (e.g., 4% paraformaldehyde) sections is used to assess the degeneration and rescue of photoreceptor cells. In the rd mouse the outer nuclear layer (photoreceptor cells) degenerate after 2-to-4 weeks in culture. The media can, be supplemented with varying doses of neuregulin to achieve an effect on retinal cell function, such as rescue of the outer nuclear layer from degeneration. Survival effects also can be shown using the TUNEL method on sections of retina analyzed in the models described above.

In Vivo Method III

In response to injury to the retina Miller cells undergo a proliferative gliosis. The mitotic activity of neuregulin on Müller glia can be shown by labeling dividing cells with a DNA synthesis precursor following administration of the factor. Labeled cells can be detected by autoradiography ($^3$H-dT) or by immunostaining (BrdU labeling) and quantified.

In Vivo Method IV

Neuregulins can be shown to promote retinal ganglion cell survival following optic nerve axotomy or nerve crush using methods described in Sievers et al., *Neurosci. Lett.* 76: 157, 1987; Carmignoto et al., *J. Neurosci.* 2:1263, 1989; Mey and Thanos, *Brain Res.* 602:304, 1993. Briefly, 4-to-6 week old mice are anesthetized, the optic nerve exposed and crushed intraorbitally 2–4 mm posterior to the optic disk between fine forceps for 30–60 sec. Alternatively, the nerve is transected surgically. Administration of neuregulin by intravitreal or subretinal injection is done after the animals recover from surgery using a therapeutically effective dose. The survival of retinal ganglion cells is assessed at several times points between 3 days and 6 weeks after injection by histological analysis (Method H1) or by immunostaining using antibodies that recognize retinal ganglion cells as described herein.

In Vivo Method V

Ischemia can be produced in the retina of the albino Lewis rat by raising intraocular pressure by intraocular injection of saline (Unoki and LaVail, *Invest Ophthalmol Vis. Sci.* 35:907, 1994). The thickness of the inner retinal layer is reduced due to loss of retinal ganglion cells when retinas are analyzed histologically (Method H1) at 7 days post-ischemia. An intravitreal injection of a therapeutically effective amount of neuregulin given two days prior to ischemia can reduce the ischemic damage.

In Vivo Method VI

Other compounds, in particular peptides, which specifically bind and/or activate erbB receptors also can be used according to the invention as effectors of retinal cell function. A candidate compound can be routinely screened for erbB receptor binding, and if it binds, can then be screened for affecting retinal cell function using the methods described herein.

In Vivo Method VII

Inadequate amounts of survival-promoting factors can lead to degenerative eye disorders, such as macular degeneration. The present invention demonstrates the survival-promoting activity of neuregulin indicating that these factors may be used to promote retinal cell survival in a vertebrate (preferably a mammal, more preferably a human) by administering to the vertebrate an effective amount of a polypeptide or a related compound. Neuregulin effects on retinal cells may occur, for example, by preventing the extent of naturally-occurring programmed cell death that occurs during the embryonic development of the retina. In a rat model, retinal ischemia can be induced by increasing intraocular pressure via injection of saline into the eye (Buchi et al., *Ophthalmologic.* 203:138, 1991; Hughes, *Exp. Eye Res.* 53:573, 1991). This model has been used to evaluate the efficacy of bFGF, CNTF and BDNF in decreasing neuronal loss (Unoki and LaVail, *Invest. Ophthalmol. Vis. Sci.* 35:907, 1994). Neuregulins administered by intraocular injection can be shown to decrease neuronal loss associated with retinal ischemia in this animal model. Neuregulin effects on retinal cell survival can be shown in genetic and transgenic mouse models for Retinitis Pigmentosa (rp). Histological analysis (Method H1) of the retina of rp mice following intravitreal administration of neuregulin can be used to rescue retinal cell degeneration.

The demonstration of biological activity of the neuregulins by promoting retinal cell function in any of the animal models described above indicates efficacy in treating disorders of the eye. A variety of retinal diseases and related disorders are known that produce impaired vision and in some cases progress to total blindness. These disorders of the eye include, but are not necessarily limited to: various retinopathies, such as hypertensive retinopathy, diabetic retinopathy and occlusive retinopathy; also injuries and disorders resulting in retinal degeneration, such as retinal tearing and detachment and inherited diseases, such as retinitis pigmentosa; also age-related macular degeneration (ARMD) and related diseases, such as idiopathic central serous chorioretinopathy, central areolar choroidal dystrophy, macular holes, macular coloboma, Stargardt hereditary dystrophy, trauma, diabetic circinate maculopathy, angioid streaks and choroidal neovascularization, presumed ocular histoplasmosis and choroidal neovascularization, angiomatosis retinae, choroidal rupture and choroidal neovascularization, toxoplasmosis and choroidal neovascularization; diseases of the optic nerve; and glaucoma and retinal ischemia. Thus, administration of neuregulin in a therapeutically effective amount can provide a treatment for disorders of the eye, which otherwise left untreated would result in the loss of sight.

The invention includes use of any modifications or equivalents of the above polypeptide factors which do not exhibit a significantly reduced activity related to affecting retinal cell function. For example, modifications in which amino acid content or sequence is altered without substantially adversely affecting activity are included. The statements of effect and use contained herein are therefore to be construed accordingly, with such uses and effects employing modified or equivalent factors being part of the invention.

The invention includes the use of the above named family of proteins (i.e. neuregulins) as extracted from natural sources (tissues or cell lines) or as prepared by recombinant means.

The human peptide sequences described above represent a series of splicing variants which can be isolated as full length complementary DNAs (cDNAs) from natural sources (cDNA libraries prepared from the appropriate tissues) or can be assembled as DNA constructs with individual exons (e.g., derived as separate exons) by someone skilled in the art.

The invention includes methods for the use of any protein which is substantially homologous to the coding segments in FIG. 13, as well as other naturally occurring neuregulin polypeptides for the purpose of promoting retinal cell function. Also included are the use of: allelic variations; natural mutants; induced mutants; proteins encoded by DNA that hybridizes under high or low stringency conditions to a nucleic acid naturally occurring (for definitions of high and low stringency see *Current Protocols in Molecular Biology*, (1989) John Wiley & Sons, New York, N.Y., 6.3.1–6.3.6, hereby incorporated by reference); and the use of polypeptides or proteins specifically bound by antisera to GGF polypeptides. The term also includes the use of chimeric polypeptides that include the GGF polypeptides comprising sequences from FIG. 13.

Use of Neuregulins

A novel aspect of the invention involves the use of neuregulins as factors to promote retinal cell function. Treatment of the cells to achieve these effects may be achieved by contacting cells with a polypeptide described herein.

The methods of the invention make use of the fact that the neuregulin proteins are encoded by the same gene. A variety of messenger RNA splicing variants (and their resultant proteins) are derived from this gene and many of these products show binding to erbB receptors and activation of the same. This invention provides a use for all of the known products of the neuregulin gene (described herein and in the references listed above). Most preferably, recombinant human GGF2 (rhGGF2) is used in these methods.

Figure 12:
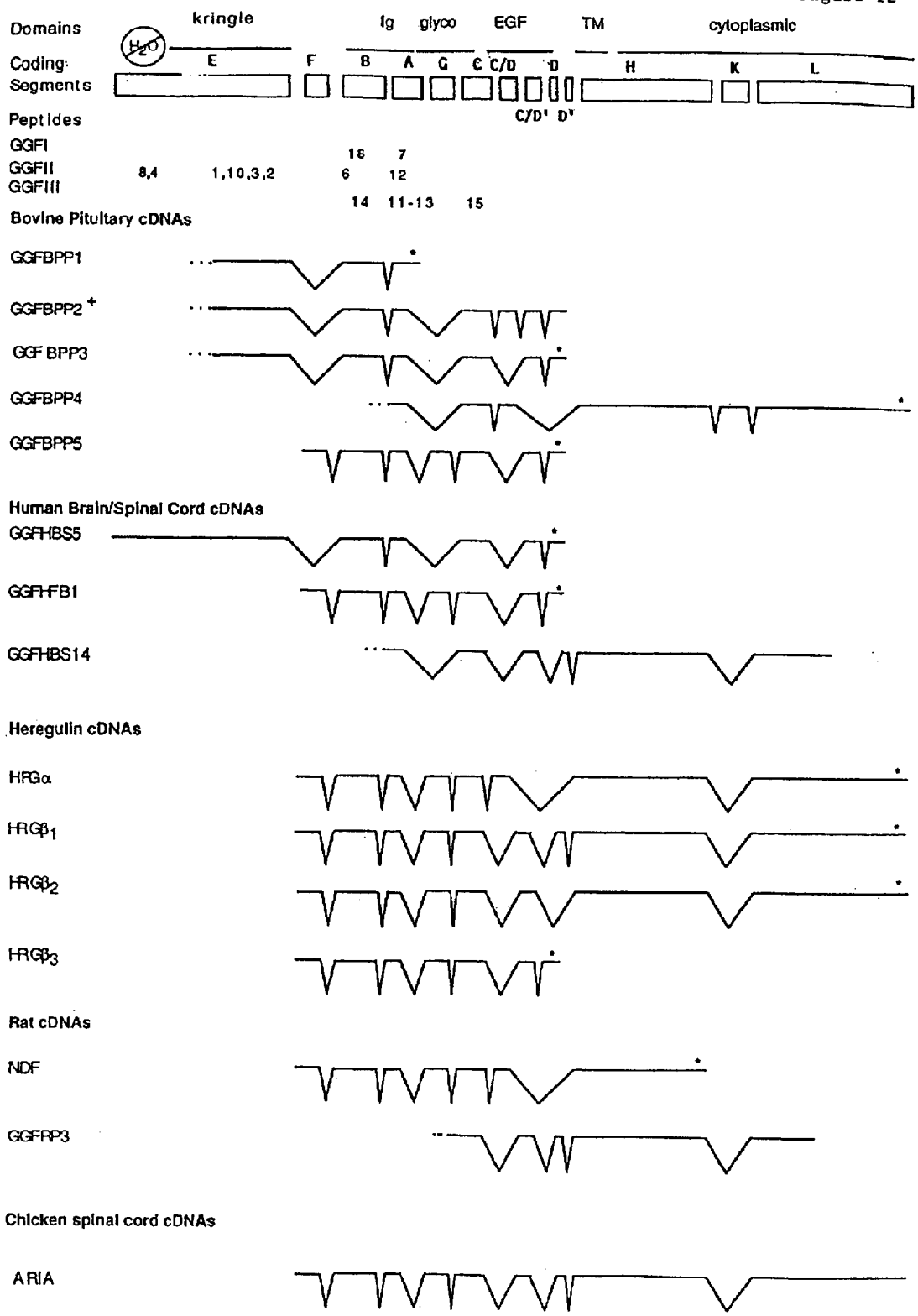
FIG. 12 shows products of the neuregulin gene.

The invention also relates to the use of other, not yet naturally isolated, splicing variants of the neuregulin gene. FIG. 12 shows the known patterns of splicing. These patterns are derived from polymerase chain reaction experiments (on reverse transcribed RNA), analysis of cDNA clones (as presented within), and analysis of published sequences encoding neuregulins (Peles et al., *Cell* 69:205, 1992 and Wen et al., *Cell* 69:559, 1992). These patterns, as well as additional patterns disclosed herein, represent probable splicing variants which exist. The splicing variants are fully described in Goodearl et al., U.S. Pat. No. 5,530,109, filed Mar. 24, 1993, incorporated herein, by reference.

More specifically, effects on retinal cell function may be achieved by contacting cells with a polypeptide defined by the formula WYBAZCX (SEQ ID NOs: 138–305)

wherein WYBAZCX is composed of the polypeptide segments shown in FIG. 13; wherein W comprises the polypeptide segment F, or is absent wherein Y comprises the polypeptide segment E, or is absent; wherein Z comprises the polypeptide segment G or is absent; and wherein X comprises the polypeptide segment C/D HKL, C/D H, C/D HL, C/D D, C/D' HL, C/D' HKL, C/D' H, C/D' D, C/D C/D' HKL, C/D C/D' H, C/D C/D' HL, C/D C/D' D, C/D D' H, C/D D' HL, C/D D' HKL, C/D' D' H, C/D' D' HL, C/D' D' HKL, C/D C/D' D' H, C/D C/D' D' HL, or C/D C/D' D' HKL (SEQ ID NOs: 309–329, respectively).

Furthermore, the invention includes a method of treating retinal cells by the application to the retinal cell of a 30 kD polypeptide factor isolated from the MDA-MB 231 human breast cell line; or 35 kD polypeptide factor isolated from the rat I-EJ transformed fibroblast cell line to the glial cell; or 75 kD polypeptide factor isolated from SKBR-3 human breast cell line; or 44 kD polypeptide factor isolated from the rat I-EJ transformed fibroblast cell line; or 25 kD polypeptide factor isolated from activated mouse peritoneal macrophages; or 45 kD polypeptide factor isolated from the MDA-MB 231 human breast cell; or 7 to 14 kD polypeptide factor isolated from the ATL-2 human T-cell line to the glial cell; or 25 kD polypeptide factor isolated from the bovine kidney cells; or 42 kD ARIA polypeptide factor isolated from brain; or 46–47 kD polypeptide factor which stimulates 0-2A glial progenitor cells; or 43–45 kD polypeptide factor, GGFIII, U.S. patent application Ser. No. 07/931,041, filed Aug. 17, 1992, now abandoned, incorporated herein by reference.

The invention includes use of any modifications or equivalents of the above polypeptide factors which do not exhibit a significantly reduced activity. For example, modifications in which amino acid content or sequence is altered without substantially adversely affecting activity are included. The statements of effect and use contained herein are therefore to be construed accordingly, with such uses and effects employing modified or equivalent factors being part of the invention.

The human peptide sequences described above and presented in FIGS. 13, 14, 15, and 16, respectively, represent a series of splicing variants which can be isolated as full-length complementary DNAs (cDNAs) from natural sources (cDNA libraries prepared from the appropriate tissues) or can be assembled as DNA constructs with individual exons (e.g., derived as separate exons) by someone skilled in the art.

Another aspect of the invention is the use of a pharmaceutical or veterinary formulation comprising any factor as defined above formulated for pharmaceutical or veterinary use, respectively, optionally together with an acceptable diluent, carrier or excipient and/or in unit dosage form. In using the factors of the invention, conventional pharmaceutical or veterinary practice may be employed to provide suitable formulations or compositions.

A medicament is made by administering the polypeptide with a pharmaceutically effective carrier. Neuregulins can be administered intravitreally by insertion of a needle through the sclera, choroid and retina and then injection of factor formulated in an appropriate vehicle for administration. The factor may also be delivered subretinally by a transpleural injection. There is also the option of delivering the factor intraocularly using ethylene-vinyl acetate copolymer implants or by delivery to the corneal surface via eye drops.

Thus, the formulations to be used as a part of the invention can be applied to parenteral administration, for example, intravenous, subcutaneous, intramuscular, intraorbital, ophthalmic, intraperitoneal, topical, intranasal, aerosol, transdermal and by other slow release devices (i.e., osmotic pump-driven devices; see also U.S. Pat. No. 5,681,568, hereby incorporated by reference).

The formulations of this invention may also be administered by the transplantation into the patient of host cells expressing the DNA encoding polypeptides which are effective for the methods of the invention or by the use of surgical implants which release the formulations of the invention.

Parenteral formulations may be in the form of liquid solutions or suspensions; for oral administration, formulations maybe in the form of tablets or capsules; and for intranasal formulations, in the form of powders, nasal drops, or aerosols.

Methods well-known in the art for making formulations are to be found in; for example, "Remington's Pharmaceutical Sciences." Formulations for parenteral administration may, for example, contain as excipients sterile water or saline, polyalkylene glycols such as polyethylene glycol, oils of vegetable origin, or hydrogenated naphthalenes, biocompatible, biodegradable lactide polymer, or polyoxyethylene-polyoxypropylene copolymers may be used to control the release of the present factors. Other potentially useful parenteral delivery systems for the factors include ethylene-vinyl acetate copolymer particles, osmotic pumps, implantable infusion systems, and liposomes. Formulations for inhalation may contain as excipients, for example, lactose, or may be aqueous solutions containing, for example, polyoxyethylene-9-lauryl ether, glycocholate and deoxycholate, or may be oily solutions for administration in the form of nasal drops, or as a gel to be applied intranasally. Formulations for parenteral administration may also include glycocholate for buccal administration, methoxysalicylate for rectal administration, or citric acid for vaginal administration.

The present factors can be used as the sole active agents, or can be used in combination with other active ingredients, e.g., other growth factors which could facilitate neuronal survival in neurological diseases, or peptidase or protease inhibitors.

The concentration of the present factors in the formulations of the invention will vary depending upon a number of issues, including the dosage to be administered, and the route of administration.

In general terms, the factors of this invention may be provided in an aqueous physiological buffer solution containing about 0.1 to 10% w/v compound for parenteral administration. General dose ranges are from about 1 μg/kg to about 1 g/kg of body weight per day; a preferred dose range is from about 0.01 mg/kg to 100 mg/kg of body weight per day. The preferred dosage to be administered is likely to depend upon the type and extent of progression of the pathophysiological condition being addressed, the overall health of the patient, the make up of the formulation, and the route of administration.

A further general aspect of the invention is the use of a factor of the invention in the manufacture of a medicament, preferably for the treatment of a disease or disorder. The "GGF2" designation is used for all clones which were previously isolated with peptide sequence data derived from GGF-II protein (i.e., GGF2HBS5, GGF2BPP3) and, when present alone (i.e., GGF2 OR rhGGF2), to indicate recombinant human protein encoded by plasmids isolated with peptide sequence data derived from the GGF-II protein (i.e., as produced in insect cells from the plasmid HBS5). Recombinant human GGF from the GGFHBS5 clone is called GGF2, rhGGF2 and GGF2HBS5 polypeptide.

Methods for treatment of diseases or disorders using nucleic acid constructs encoding neuregulins or neuregulin producer cells are also part of the invention.

Delivery of DNA to a cell or tissue that will take up the DNA, express the DNA and produce neuregulin as shown by Wolff et al., (*Science* 247:1465, 1990) and Ascadi et al., (*Nature* 352:815, 1991) is an aspect of the invention. Genetic modification of cultured cells (or their precursors) such as fibroblasts (as shown by Wolff et al. *Proc. Nat'l Acad. Sci. USA* 86:1575, 1988) or such as those derived from the nervous system (as shown by Weiss et al. International Patent Application number PCT/US94/01053; publication number WO 94/16718) to induce the production of neuregulin from the cultured cells is another aspect of this invention. The genetically modified neuregulin producer cells can be transplanted to a position near the retinal cell type and elicit the responses described above.

Other Embodiments

The invention includes methods for the use of any protein which is substantially homologous to the coding segments in FIG. 13 as well as other naturally occurring GGF or neuregulin polypeptides for the purpose of promoting retinal cell function. Also included are the use of: allelic variations; natural mutants; induced mutants; proteins encoded by DNA that hybridizes under high or low stringency conditions to a nucleic acid naturally occurring (for definitions of high and low stringency see *Current Protocols in Molecular Biology*, John Wiley & Sons, New York, 1989; 6.3.1–6.3.6, hereby incorporated by reference); and the use of polypeptides or proteins specifically bound by antisera to GGF polypeptides. The term also includes the use of chimeric polypeptides that include the GGF polypeptides comprising sequences from FIG. 11 for the promotion of retinal cell function.

As will be seen from Example 2, below, the present factors exhibit survival activity on retinal cells. The general statements of invention above in relation to formulations and/or medicaments and their manufacture should clearly be construed to include appropriate products and uses.

A series of experiments follow which provide additional basis for the claims described herein. The following examples relating to the present invention should not be construed as specifically limiting the invention, or such variations of the invention, now known or later developed.

The examples illustrate our discovery that recombinant human GGF2 (rhGGF2) confers survival effects on retinal cell culture. These activities indicate efficacy of GGF2 and other neuregulins in inducing wound repair and repair of other retinal tissue damage, and promoting regeneration and prophylactic effects on retinal tissue degeneration.

EXAMPLES

The following examples are designed to illustrate certain aspects of the present invention. The examples are not intended to be comprehensive of all embodiments of the present invention, and should not be construed as limiting the claims presented herein.

Example 1

Neuregulin Expression in Embryonic and Adult Retina

Figure 2:
FIG. 2 is immunostaining showing that neuregulin protein is expressed in the retinal ganglion cell layer during embryonic retinal development. Arrows point to labeling in the developing ganglion cell layer.

Neuregulin is expressed in the retina of the developing embryo and in adult rat. The pattern of expression has been demonstrated by in situ hybridization (FIG. 3) and also by immunostaining (FIGS. 2 and 4). Expression is detected in the retinal ganglion cell layer. The expression occurs at a point in development when the retinal layers are undergoing differentiation and when the retinal ganglion cells are extending their axons and making connections to target of innervation in the brain (lateral geniculate and superior colliculus). The timing and distribution of neuregulin gene products in the retina suggests the neuregulins have a role in the development and/or maintenance of the cells in the retina and their associated tissues.

Figure 3:
FIG. 3 is in situ hybridization showing that neuregulin mRNA is expressed in cells of the retinal ganglion cell layer during embryonic development. Arrows point to the labeling in the ganglion cell layer, showing that the distribution is similar to the neuregulin immunoreactivity shown in FIG. 2.

Methods
In situ hybridization (see FIG. 3). Ten micron frozen section was incubated with a single-stranded digoxigenin-labeled riboprobe (antisense strand) encoding the EGF-like domain through the cytoplasmin domain of the rat cDNA clone GGFRP3 (Marchionni et al., *Nature* 362:312, 1993).
Immunostaining. Ten micron frozen section of embryonic day 16 rat retina was incubated in CN16 (anti-rhGGF2) antibody at approximately 10 mg/ml for 12 hours, and the antibody binding was revealed using indirect immunohistochemistry with a peroxidase conjugated secondary antibody (see FIG. 2).

Ten micron frozen section from an adult rat retina was incubated in CN16 as described in FIG. 1, except that a fluorescein conjugated secondary antibody was used to reveal the binding of the primary antibody (see FIG. 4). Neuregulin immunoreactivity is present in the synaptic layers of the retina, where the processes of the retinal ganglion cells connect with the retinal interneurons (inner plexiform layer, large arrows) and in the outer plexiform layer (small arrows, where the processes of the photoreceptors make synapses with the second order retinal neurons, the bipolar cells and the horizontal cells).

Figure 5:
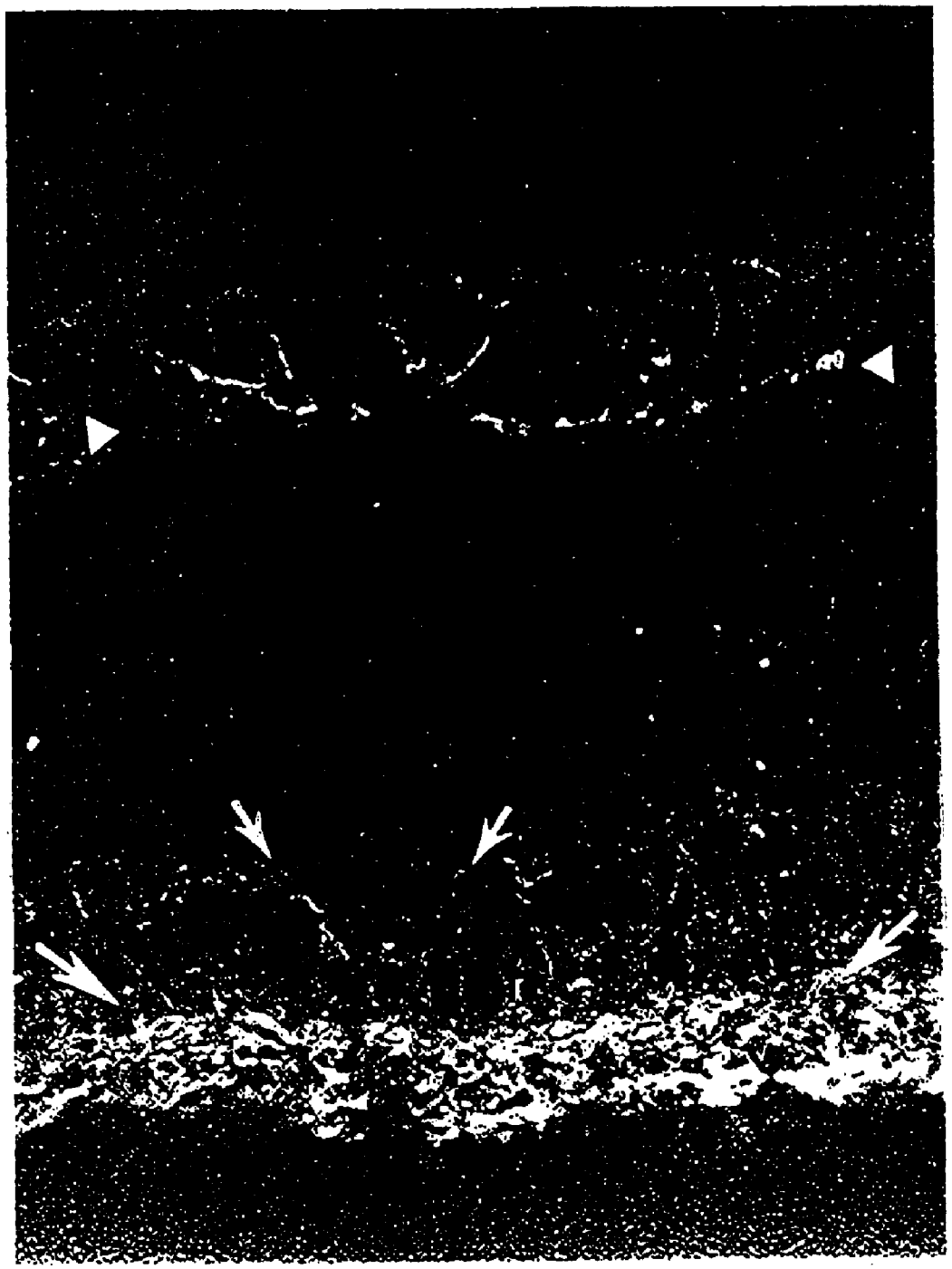
FIG. 5 is immunostaining showing that TUJ1 immunoreactivity is expressed in the newborn rat retina and shows that retinal ganglion cells are the primary cell class that expresses this-antigen at this stage of development. The retinal ganglion cell layer is marked with large arrows, while the labeled amacrine cells are marked with the small arrows and the labeled horizontal cells are marked with the arrowheads.

Ten micron section from a newborn rat retina incubated with TUJ1 antibody, a mouse monoclonal antibody that recognizes neuron-specific beta -tubulin (from Dr. A. Frankfurter, UVA). The antibody binding was revealed by indirect immunohistochemistry with a fluorescein conjugated secondary antibody (see FIG. 5).

Example 2

Neuregulin (rhGGF2) Promotes Survival of Retinal Cells in Vitro

Figure 6:
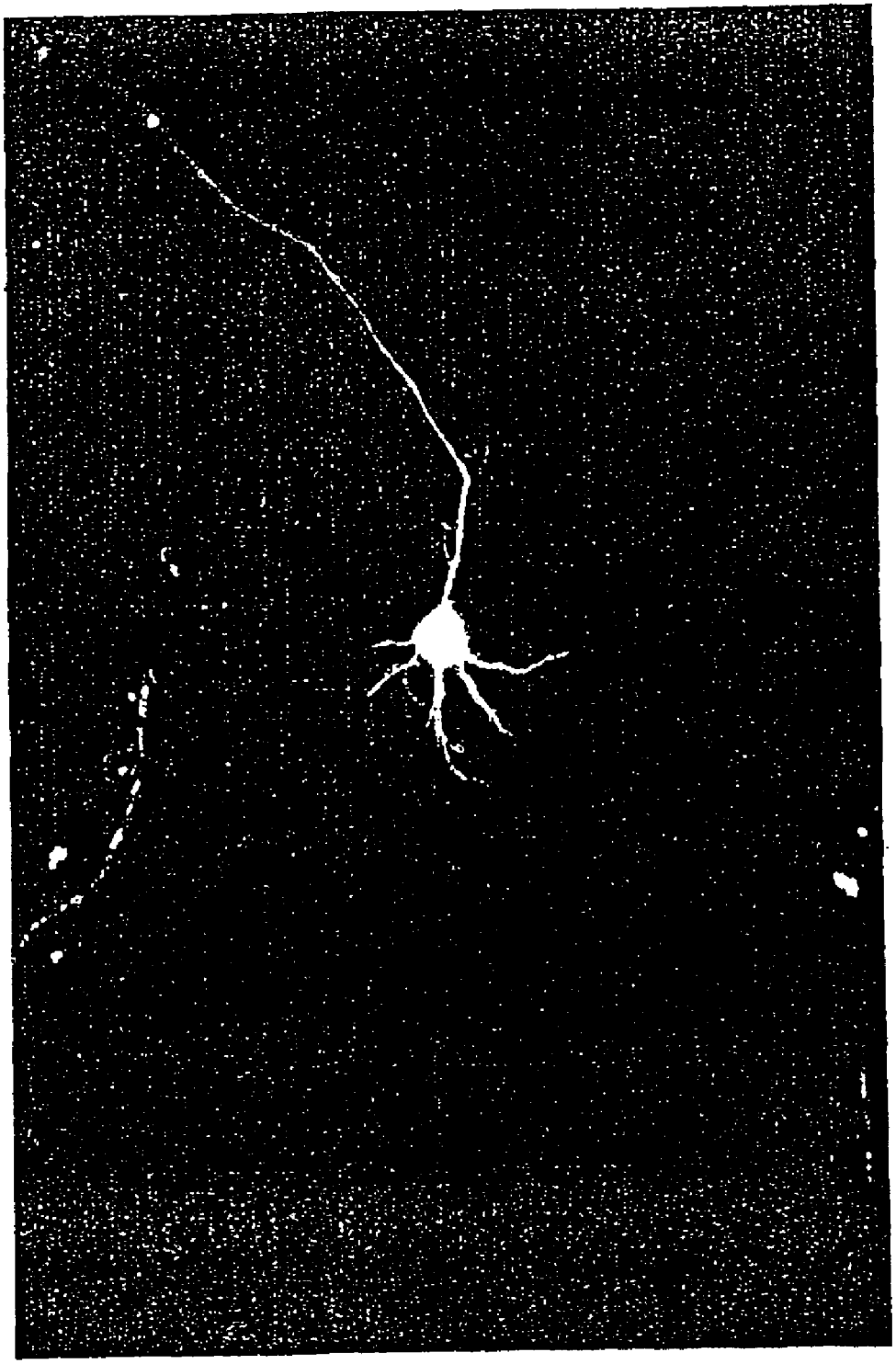
FIG. 6 is an immunostained culture of rat retinal neurons, which were grown for two days in the presence of rhGGF2 (neuregulin) on collagen gels showing extended long processes labeled with the TUJ1 antibody.
Figure 7:
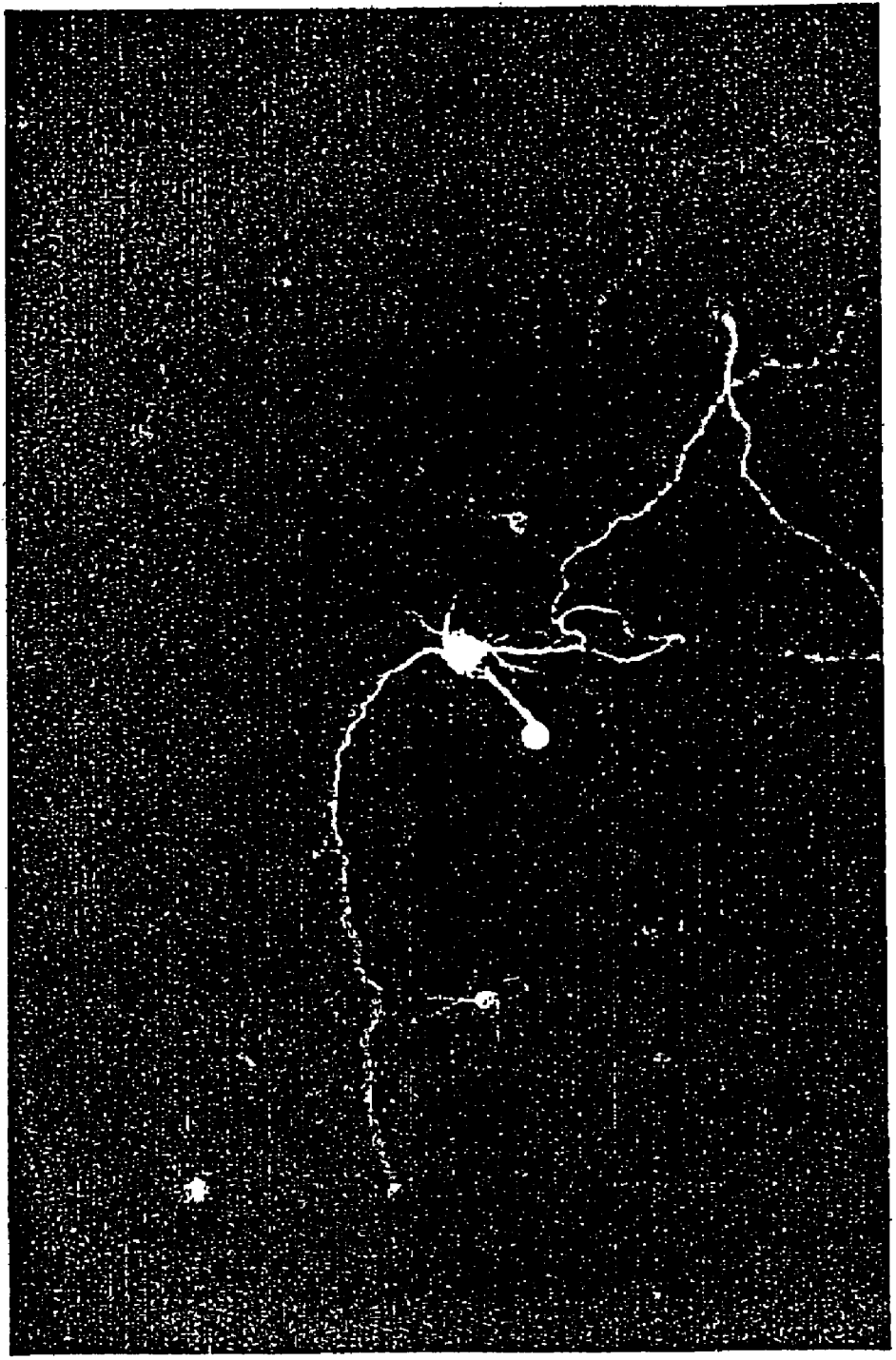
FIG. 7 is an immunostained culture of rat retinal cells showing that neuregulin (rhGGF2) causes a significant increase in TUJ1 immunoreactive in embryonic day 18 rat retinal cells after two days of culture.
Figure 8:
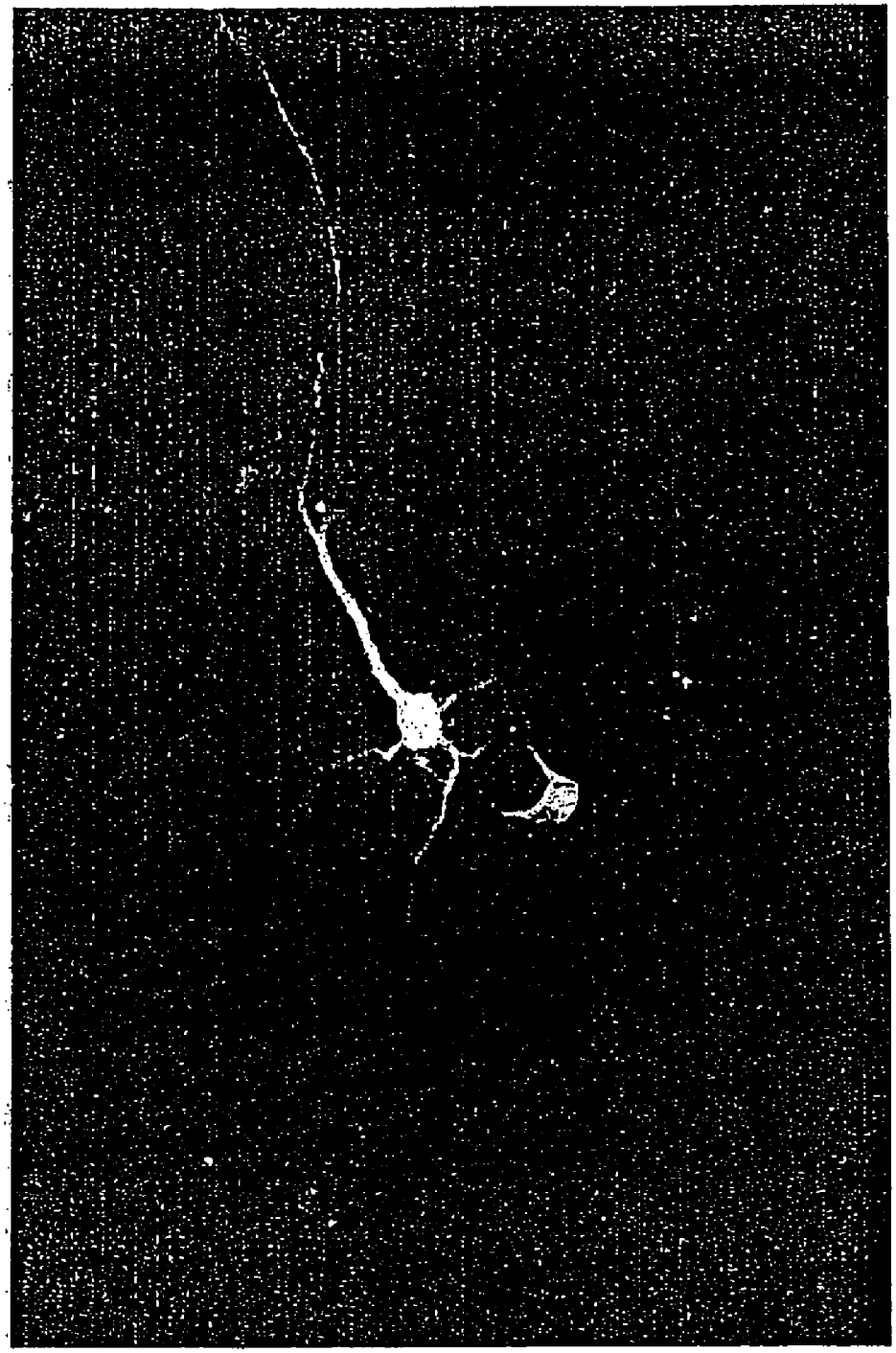
FIG. 8 is an immunostained culture of rat retinal cells showing that the neuregulin (rhGGF2)-induced cell survival is age dependent: neuregulin (rhGGF2) does not cause a significant increase in TUJ1 immunoreactive embryonic day 15 rat retinal cells after two days of culture.
Figure 9:
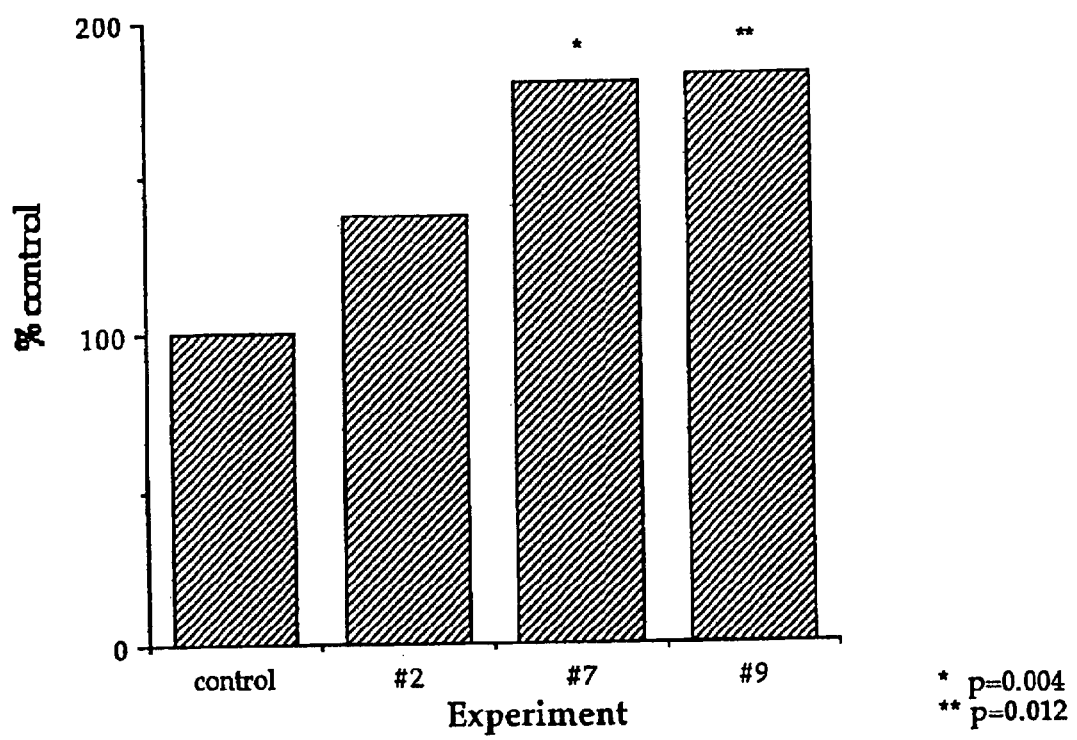
FIG. 9 is a bar graph of the results of three separate experiments with embryonic day 18 rat retinal cells.
Figure 10:
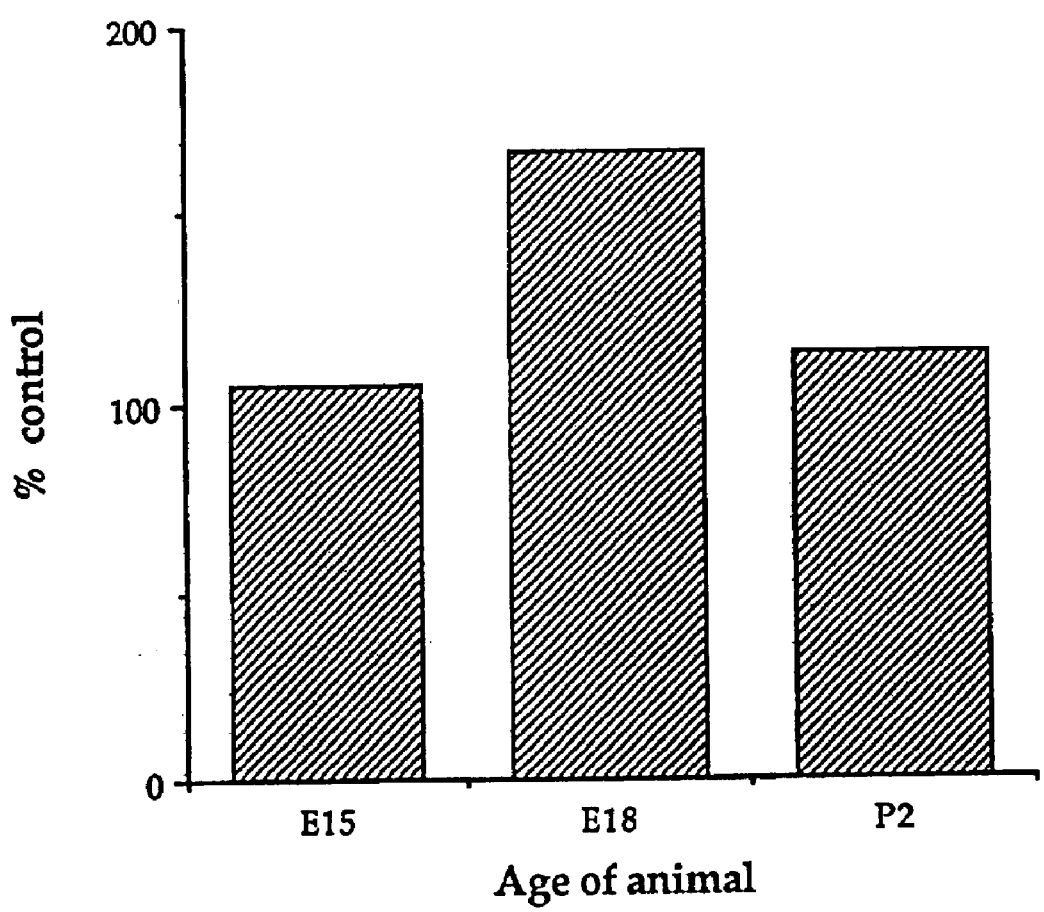
FIG. 10 is a bar graph of the experimental results showing the effects of GGF on retinal cell survival.

Embryonic and newborn rat retinal cells were cultured for 2 days on collagen gel coated coverslips and then fixed and labeled with an antibody (TUJ1) that identifies primarily retinal ganglion cells at these stages of development (see FIG. 6). All the labeled cells with processes on the sample coverslips were counted. Final concentrations of rhGGF2 in the culture wells ranged from 0.01 to 100 ng/ml. No clear dose response was observed, so the data from all rhGGF2 treated wells was combined for the analysis. Three separate experiments with embryonic day 18 cells all showed an increase in the number of TUJ1 immunoreactive cells with processes after two days in vitro (see FIG. 7). Unpaired sample student's T-test showed that the increases in cell survival were statistically significant with $p<0.004$ and $p<0.012$. Two experiments with embryonic day 15 cells and one experiment with newborn rat retinal cells did not show any significant differences from control (see FIG. 8). From these observations we conclude that rhGGF2 promotes rat retinal cell survival in cell culture in an age-dependent manner. This age-dependence could represent either a changing requirement for this factor of a specific retinal cell population or a change in the relative number of the responsive cells in the population during these developmental stages. When assayed either alone or in combination with EGF, rhGGF2 had no mitogenic activity retinal cells in vitro at any of the ages tested.

Methods
Embryonic rat retinal cell were dissociated and plated at low density on collagen gels and allowed to survive for two days with 10 ng/ml rhGGF2 (neuregulin) added to the medium. After fixation in 4% paraformaldehyde, the cells were stained with TUJ1 antibody to reveal the full extent of their processes and all the cells that survived for two days with intact, non-fragmented processes were counted.

SEQUENCE LISTING (329 sequences)

SEQ ID NO: 1 - DNA, 743 bp, Homo sapiens
  CDS (8)...(625)
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtgtgaaatctcattgtgaacaaataaaaatcatgaaaggaaaaaaaaaaaaaaaaatcgatgtcgactcgagatgtggctgcaggtcgactctagaggatccc

SEQ ID NO: 2 - protein, 206 aa, Homo sapiens
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNGKRCLLRAISQSLRGVIKVCGHT

SEQ ID NO: 3 - DNA, 1194 bp, Bos taurus
  CDS (8)...(796)
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattcctcctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaaattgatcttgaattactgtgatacgacatgatagtccctctcacccagtgcaatgacaataaaggccttgaaaagtcaaaaaaaaaaaaaaaaaaaaaaatcgatgtcgactcgagatgtggctgcaggtcgactctagag

SEQ ID NO: 4 - protein, 263 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCQPGFTGARCTENVPMKVQTQESAQMSLLVIAAKTT

SEQ ID NO: 5 - DNA, 1108 bp, Bos taurus
  CDS (8)...(778)
cctgcagcatcaagtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattccgcctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtcaaaaaaaaaaaaaaaaaaaaaatcgatgtcgactcgagatgtggctg

SEQ ID NO: 6 - protein, 257 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCPNEFTGDRCQNYVMASFYSTSTPFLSLPE

SEQ ID NO: 7 - DNA, 559 bp, Bos taurus
  CDS (460)...(559)
  variation 214: n= a, t, c, or g.
agtttccccccccaacttgtcggaactctgggctcgcgcgcagggcaggagcggagcggcggcggctgcccaggcgatgcgagcgcgggccggacggtaatcgcctctccctcctcgggctgcgagcgcgccggaccgaggcagcgacaggagcggaccgcggcgggaaccgaggactccccagcggcgcgccagcaggagccaccccgcgagncgtgcgaccgggacggagcgcccgccagtcccaggtggcccggaccgcacgttgcgtccccgcgctccccgccggcgacaggagacgctcccccccacgccgcgcgcgcctcggcccggtcgctggcccgcctccactccggggacaaacttttcccgaagccgatcccagccctcggacccaaacttgtcgcgcgtcgccttcgccgggagccgtccgcgcagagcgtgcacttctcgggcgagatgtcggagcgcagagaaggcaaaggcaaggggaagggcggcaagaaggaccgaggctccgggaagaagcccgtgcccgcggctggcggcccgagcccag

SEQ ID NO: 8 - protein, 33 aa, Bos taurus
MSERREGKGKGKGGKKDRGSGKKPVPAAGGPSP

SEQ ID NO: 9 - DNA, 231 bp, Homo sapiens
cgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccag

SEQ ID NO: 10 - DNA, 252 bp, Bos taurus
  CDS (3)...(251)
  variation 8: n=a, t, c, or g
cccatcangtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcg

SEQ ID NO: 11 - protein, 83 aa, Bos taurus
  VARIANT 2: Xaa is Gln
HXVWAAKAGGLKKDSLLTVRLGAWGHPAFPSCGRLKEDSRYIFFMEPEANSSGGPGRLPSLLPPSRDGPEPQEGGQPGAVQRC

SEQ ID NO: 12 - DNA, 178 bp, Bos taurus
  CDS (3)...(176)
ccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccacaaaacatcaagatacagaaaaggccggg

SEQ ID NO: 13 - protein, 58 aa, Bos taurus
LPPRLKEMKSQESVAGSKLVLRCETSSEYSSLKFKWFKNGSELSRKNKPQNIKIQKRP

SEQ ID NO: 14 - DNA, 178 bp, Homo sapiems
ccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagg

SEQ ID NO: 15 - DNA, 122 bp, Bos taurus
  CDS (2)...(122)
gaagtcagaacttcgcattagcaaagcgtcactggctgattctggagaatatatgtgcaaagtgatcagcaaactaggaaatgacagtgcctctgccaacatcaccattgtggagtcaaacg

SEQ ID NO: 16 - protein, 40 aa, Bos taurus
KSELRISKASLADSGEYMCKVISKLGNDSASANITIVESN

SEQ ID NO: 17 - DNA, 122 bp, Homo sapiens
gaagtcagaacttcgcattaacaaagcatcactggctgattctggagagtatatgtgcaaagtgatcagcaaattaggaaatgacagtgcctctgccaatatcaccatcgtggaatcaaacg

SEQ ID NO: 18 - DNA, 418 bp, Homo sapiens
  CDS (84)...(272)
tctaaaactacagagactgtattttcatgatcatcatagttctgtgaaatatacttaaaccgctttggtcctgatcttgtaggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtgtgaaatctcattgtgaacaaataaaaatcatgaaaggaaaactctatgtttgaaatatcttatgggtcctcctgtaaagctcttcactccataaaggtgaaatagacctgaaatatatatagattattt

SEQ ID NO: 19 - protein, 63 aa, Homo sapiens
KSELRISKASLADSGEYMCKVISKLGNDSASANITIVESNGKRCLLRAISQSLRGVIKVCGHT

SEQ ID NO: 20 - DNA, 102 bp, Bos taurus
  CDS (3)...(102)
agatcaccactggcatgccagcctcaactgagacagcgtatgtgtcttcagagtctcccattagaatatcagtatcaacagaaggaacaaatacttcttcat

SEQ ID NO: 21 - protein, 33 aa, Bos taurus
ITTGMPASTETAYVSSESPIRISVSTEGTNTSS

SEQ ID NO: 22 - DNA, 102 bp, Homo sapiens
agatcatcactggtatgccagcctcaactgaaggagcatatgtgtcttcagagtctcccattagaatatcagtatccacagaaggagcaaatacttcttcat

SEQ ID NO: 23 - DNA, 128 bp, Bos taurus
  CDS (3)...(128)
ccacatccacatctacagctgggacaagccatcttgtcaagtgtgcagagaaggagaaaactttctgtgtgaatggaggcgagtgcttcatggtgaaagacctttcaaatccctcaagatacttgtgc

SEQ ID NO: 24 - protein, 42 aa, Bos taurus
TSTSTAGTSHLVKCAEKEKTFCVNGGECFMVKDLSNPSRYLC

SEQ ID NO: 25 - DNA, 128 bp, Homo sapiens
ctacatctacatccaccactgggacaagccatcttgtaaaatgtgcggagaaggagaaaactttctgtgtgaatggaggggagtgcttcatggtgaaagacctttcaaacccctcgagatacttgtgc

SEQ ID NO: 26 - DNA, 69 bp, Bos taurus
  CDS (1)...(69)
aagtgccaacctggattcactggagcgagatgtactgagaatgtgcccatgaaagtccaaacccaagaa

SEQ ID NO: 27 - protein, 23 aa, Bos taurus
KCQPGFTGARCTENVPMKVQTQE

SEQ ID NO: 28 - DNA, 69 bp, Homo sapiens
aagtgccaacctggattcactggagcaagatgtactgagaatgtgcccatgaaagtccaaaaccaagaa

SEQ ID NO: 29 - DNA, 60 bp, Bos taurus
  CDS (1)...(60)
aagtgcccaaatgagtttactggtgatcgctgccaaaactacgtaatggccagcttctac

SEQ ID NO: 30 - protein, 20 aa, Bos taurus
KCPNEFTGDRCQNYVMASFY

SEQ ID NO: 31 - DNA, 60 bp, Homo sapiens; identical to SEQ ID NO: 29

SEQ ID NO: 32 - DNA, 36 bp, Homo sapiens
  CDS (1)...(33)
agtacgtccactccctttctgtctctgcctgaatag

SEQ ID NO: 33 - protein, 11 aa, Homo sapiens
STSTPFLSLPE

SEQ ID NO: 34 - DNA, 27 bp, Homo sapiens
  CDS (1)...(27)
aagcatcttgggattgaatttatggag

SEQ ID NO: 35 - protein, 9 aa, Homo sapiens
KHLGIEFME

SEQ ID NO: 36 - DNA, 569 bp, Bos taurus
  CDS (1)...(564)
aaagcggaggagctctaccagaagagagtgctcaccattaccggcatttgcatcgcgctgctcgtggttggcatcatgtgtgtggtggtctactgcaaaaccaagaaacaacggaaaaagcttcatgaccggcttcggcagagccttcggtctgaaagaaacaccatgatgaacgtagccaacgggccccaccaccccaatccgccccccgagaacgtgcagctggtgaatcaatacgtatctaaaaatgtcatctctagcgagcatattgttgagagagaggcggagagctctttttccaccagtcactacacttcgacagctcatcattccactactgtcactcagactcccagtcacagctggagcaatggacacactgaaagcatcatttcggaaagccactctgtcatcgtgatgtcatccgtagaaaacagtaggcacagcagcccgactgggggcccgagaggacgtctcaatggcttgggaggccctcgtgaatgtaacagcttcctcaggcatgccagagaaacccctgactcctaccgagactctcctcatagtgaaag

SEQ ID NO: 37 - protein, 188 aa, Bos taurus
KAEELYQKRVLTITGICIALLVVGIMCVVVYCKTKKQRKKLHDRLRQSLRSERNTMMNVANGPHHPNPPPENVQLVNQYVSKNVISSEHIVEREAESSFSTSHYTSTAHHSTTVTQTPSHSWSNGHTESIISESHSVIVMSSVENSRHSSPTGGPRGRLNGLGGPRECNSFLRHARETPDSYRDSPHS

SEQ ID NO: 38 - DNA, 569 bp, Homo sapiens
aaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaag

SEQ ID NO: 39 - DNA, 141 bp, Homo sapiens
  CDS (2)...(141)
acataaccttatagctgagctaaggagaaacaaggcccacagatccaaatgcatgcagatccagctttccgcaactcatcttagagcttcttccattccccattgggcttcattctctaagaccccttggcctttaggaag

SEQ ID NO: 40 - protein, 47 aa, Homo sapiens
HNLIAELRRNKAHRSKCMQIQLSATHLRASSIPHWASFSKTPWPLGG

SEQ ID NO: 41 - DNA, 730 bp, Bos taurus
  CDS (2)...(652)
gtatgtatcagcaatgaccaccccggctcgtatgtcacctgtagatttccacacgccaagctcccccaagtcacccccttcggaaatgtccccgcccgtgtccagcacgacggtctccatgccctccatggcggtcagtcccttcgtggaagaggagagacccctgctccttgtgacgccaccacggctgcgggagaagtatgaccaccacgcccagcaattcaactcgttccactgcaaccccgcgcatgagagcaacagcctgccccccagccccttgaggatagtggaggatgaggaatatgaaacgacccaggagtacgaaccagctcaagagccggttaagaaactcaccaacagcagccggcgggccaaaagaaccaagcccaatggtcacattgcccacaggttggaaatggacaacaacacaggcgctgacagcagtaactcagagagcgaaacagaggatgaaagagtaggagaagatacgcctttcctggccatacagaaccccctggcagccagtctcgaggcggcccctgccttccgcctggtcgacagcaggactaacccaacaggcggcttctctccgcaggaagaattgcaggccaggctctccggtgtaatcgctaaccaagaccctatcgctgtctaaaaccgaaatacacccatagattcacctgtaaaactttattttatataataaagtattccaccttaaattaaacaa

SEQ ID NO: 42 - protein, 217 aa, Bos taurus
YVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVDSRTNPTGGFSPQEELQARLSGVIANQDPIAV

SEQ ID NO: 43 - DNA, 730 bp, Homo sapiens
gtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaa

SEQ ID NO: 44 - DNA, 745 bp, Homo sapiens
  CDS (1)...(744)
atgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcg

SEQ ID NO: 45 - protein, 248 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRC

SEQ ID NO: 46 - DNA, 1652 bp, Homo sapiens
  CDS (459)...(1181)
agtttccccccccaacttgtcggaactctgggctcgcgcgcagggcaggagcggagcggcggcggctgcccaggcgatgcgagcgcgggccggacggtaatcgcctctccctcctcgggctgcgagcgcgccggaccgaggcagcgacaggagcggaccgcggcgggaaccgaggactccccagcggcgcgccagcaggagccaccccgcgagcgtgcgaccgggacggagcgcccgccagtcccaggtggcccggaccgcacgttgcgtccccgcgctccccgccggcgacaggagacgctcccccccacgccgcgcgcgcctcggcccggtcgctggcccgcctccactccggggacaaacttttcccgaagccgatcccagccctcggacccaaacttgtcgcgcgtcgccttcgccgggagccgtccgcgcagagcgtgcacttctcgggcgagatgtcggagcgcagagaaggcaaaggcaaggggaagggcggcaagaaggaccgaggctccgggaagaagcccgtgcccgcggctggcggcccgagcccagccttgcctccccgcttgaaagagatgaagatgcaggagtctgtggcaggttccaaactagtgcttcggtgcgagaccagttctgaatactcctctctcaagttcaagtggttcaagaatgggagtgaattaagccgaaagaacaaaccacaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgagatcaccactggcatgccagcctcaactgagacagcgtatgtgtcttcagagtctcccattagaatatcagtatcaacagaaggaacaaatacttcttcatccacatccacatctacagctgggacaagccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaataggcgcatgctcagtcggtgccgctttcttgttgccgcatctcccctcagattcaacctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtctcacttttattgagaaaataaaaatcgttccacgggacagtccctcttctttataaaatgaccctatccttgaaaaggaggtgtgttaagttgtaaccagtacacacttgaaatgatggtaagttcgcttcggttcagaatgtgttctttctgacaaataaacagaataaaaaaaaaaaaaaaaaa

SEQ ID NO: 47 - protein, 241 aa, Homo sapiens
MSERREGKGKGKGGKKDRGSGKKPVPAAGGPSPALPPRLKEMKMQESVAGSKLVLRCETSSEYSSLKFKWFKNGSELSRKNKPQNIKIQKRPGKSELRISKASLADSGEYMCKVISKLGNDSASANITIVESNEITTGMPASTETAYVSSESPIRISVSTEGTNTSSSTSTSTAGTSHLVKCAEKEKTFCVNGGECFMVKDLSNPSRYLCKCPNEFTGDRCQNYVMASFYSTSTPFLSLPE

SEQ ID NO: 48 - DNA, 1140 bp, Bos taurus
  variation 6: n= a, t, c, or g
  variation 895: n= a, t, c, or g
  CDS (1)...(840)
catcangtgtgggcggcgaaagccgggggcttgaagaaggactcgctgctcaccgtgcgcctgggcgcctggggccaccccgccttcccctcctgcgggcgcctcaaggaggacagcaggtacatcttcttcatggagcccgaggccaacagcagcggcgggcccggccgccttccgagcctccttcccccctctcgagacgggccggaacctcaagaaggaggtcagccgggtgctgtgcaacggtgcgccttgcctccccgcttgaaagagatgaagagtcaggagtctgtggcaggttccaaactagtgcttcggtgcgagaccagttctgaatactcctctctcaagttcaagtggttcaagaatgggagtgaattaagccgaaagaacaaaccagaaaacatcaagatacagaaaaggccggggaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacagtacgtccactccctttctgtctctgcctgaatagcgcatctcagtcggtgccgctttcttgttgccgcatctcccctcagattccncctagagctagatgcgttttaccaggtctaacattgactgcctctgcctgtcgcatgagaacattaacacaagcgattgtatgacttcctctgtccgtgactagtgggctctgagctactcgtaggtgcgtaaggctccagtgtttctgaaattgatcttgaattactgtgatacgacatgatagtccctctcacccagtgcaatgacaataaaggccttgaaaagtcaaaaaaaaaaaaaaaaa

SEQ ID NO: 49 - protein, 280 aa, Bos taurus
  VARIANT 2: Xaa is Gln
HXVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCQPGFTGARCTENVPMKVQTQEKCPNEFTGDRCQNYVMASFYSTSTPFLSLPE

SEQ ID NO: 50 - DNA, 1764 bp, Bos taurus
  CDS (2)...(1681)
gaagtcagaacttcgcattagcaaagcgtcactggctgattctggagaatatatgtgcaaagtgatcagcaaactaggaaatgacagtgcctctgccaacatcaccattgtggagtcaaacgccacatccacatctacagctgggacaagccatcttgtcaagtgtgcagagaaggagaaaactttctgtgtgaatggaggcgactgcttcatggtgaaagacctttcaaatccctcaagatacttgtgcaagtgccaacctggattcactggagcgagatgtactgagaatgtgcccatgaaagtccaaacccaagaaaaagcggaggagctctaccagaagagagtgctcaccattaccggcatttgcatcgcgctgctcgtggttggcatcatgtgtgtggtggtctactgcaaaaccaagaaacaacggaaaaagcttcatgaccggcttcggcagagccttcggtctgaaagaaacaccatgatgaacgtagccaacgggccccaccaccccaatccgccccccgagaacgtgcagctggtgaatcaatacgtatctaaaaatgtcatctctagcgagcatattgttgagagagaggcggagagctctttttccaccagtcactacacttcgacagctcatcattccactactgtcactcagactcccagtcacagctggagcaatggacacactgaaagcatcatttcggaaagccactctgtcatcgtgatgtcatccgtagaaaacagtaggcacagcagcccgactgggggcccgagaggacgtctcaatggcttgggaggccctcgtgaatgtaacagcttcctcaggcatgccagagaaacccctgactcctaccgagactctcctcatagtgaaagacataaccttatagctgagctaaggagaaacaaggcccacagatccaaatgcatgcagatccagctttccgcaactcatcttagagcttcttccattccccattgggcttcattctctaagaccccttggcctttaggaaggtatgtatcagcaatgaccaccccggctcgtatgtcacctgtagatttccacacgccaagctcccccaagtcacccccttcggaaatgtccccgcccgtgtccagcacgacggtctccatgccctccatggcggtcagtcccttcgtggaagaggagagacccctgctccttgtgacgccaccacggctgcgggagaagtatgaccaccacgcccagcaattcaactcgttccactgcaaccccgcgcatgagagcaacagcctgccccccagccccttgaggatagtggaggatgaggaatatgaaacgacccaggagtacgaaccagctcaagagccggttaagaaactcaccaacagcagccggcgggccaaaagaaccaagcccaatggtcacattgcccacaggttggaaatggacaacaacacaggcgctgacagcagtaactcagagagcgaaacagaggatgaaagagtaggagaagatacgcctttcctggccatacagaaccccctggcagccagtctcgaggcggcccctgccttccgcctggtcgacagcaggactaacccaacaggcggcttctctccgcaggaagaattgcaggccaggctctccggtgtaatcgctaaccaagaccctatcgctgtctaaaaccgaaatacacccatagattcacctgtaaaactttattttatataataaagtattccaccttaaattaaacaaaaaaa

SEQ ID NO: 51 - protein, 560 aa, Bos taurus
KSELRISKASLADSGEYMCKVISKLGNDSASANITIVESNATSTSTAGTSHLVKCAEKEKTFCVNGGDCFMVKDLSNPSRYLCKCQPGFTGARCTENVPMKVQTQEKAEELYQKRVLTITGICIALLVVGIMCVVVYCKTKKQRKKLHDRLRQSLRSERNTMMNVANGPHHPNPPPENVQLVNQYVSKNVISSEHIVEREAESSFSTSHYTSTAHHSTTVTQTPSHSWSNGHTESIISESHSVIVMSSVENSRHSSPTGGPRGRLNGLGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVDSRTNPTGGFSPQEELQARLSGVIANQDPIAV

SEQ ID NO: 52 - DNA, 198 bp, Homo sapiens
  CDS (1)...(195)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacagtacgtccactccctttctgtctctgcctgaatag

SEQ ID NO: 53 - protein, 65 aa, Homo sapiens
SHLVKCAEKEKTFCVNGGECFMVKDLSNPSRYLCKCPNEFTGDRCQNYVMASFYSTSTPFLSLPE

SEQ ID NO: 54 - DNA, 192 bp, Bos taurus
  CDS (1)...(189)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaaagcggaggagctctactaa

SEQ ID NO: 55 - protein, 63 aa, Bos taurus
SHLVKCAEKEKTFCVNGGECFMVKDLSNPSRYLCKCQPGFTGARCTENVPMKVQTQEKAEELY

SEQ ID NO: 56 - DNA, 183 bp, Homo sapiens
  CDS (1)...(180)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacaaagcggaggagctctactaa

SEQ ID NO: 57 - protein, 60 aa, Homo sapiens
SHLVKCAEKEKTFCVNGGECFMVKDLSNPSRYLCKCPNEFTGDRCQNYVMASFYKAEELY

SEQ ID NO: 58 - DNA, 210 bp, Homo sapiens
  CDS (1)...(207)
agccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctacaagcatcttgggattgaatttatggagaaagcggaggagctctactaa

SEQ ID NO: 59 - protein, 69 aa, Homo sapiens
SHLVKCAEKEKTFCVNGGECFMVKDLSNPSRYLCKCPNEFTGDRCQNYVMASFYKHLGIEFMEKAEELY

SEQ ID NO: 60 - DNA, 267 bp, bos taurus
  CDS (1)...(264)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacagtacgtccactccctttctgtctctgcctgaatag

SEQ ID NO: 61 - protein, 88 aa, bos taurus
SHLVKCAEKEKTFCVNGGECFMVKDLSNPSRYLCKCQPGFTGARCTENVPMKVQTQEKCPNEFTGDRCQNYVMASFYSTSTPFLSLPE

SEQ ID NO: 62 - DNA, 252 bp, Bos Taurus
  CDS (1)...(249)
agccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaaaagtgcccaaatgagtttactggtgatcgctgccaaaactacgtaatggccagcttctacaaagcggaggagctctactaa

SEQ ID NO: 63 - protein, 83 aa, Bos Taurus
SHLVKCAEKEKTFCVNGGECFMVKDLSNPSRYLCKCQPGFTGARCTENVPMKVQTQEKCPNEFTGDRCQNYVMASFYKAEELY

SEQ ID NO: 64 - DNA, 2003 bp, Homo sapiens
  CDS (265)...(1530)
  variation (31)...(32): n=a, t, c, or g.
ggaattcctttttttttttttttttttcttnntttttttttgcccttatacctcttcgcctttctgtggttccatccacttcttccccctcctcctcccataaacaactctcctacccctgcacccccaataaataaataaaaggaggagggcaaggggggaggaggaggagtggtgctgcgaggggaaggaaaagggaggcagcgcgagaagagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcccggggaggaggcgccctatctggtgaaggtgcaccaggtgtgggcggtgaaagccgggggcttgaagaaggactcgctgctcaccgtgcgcctggggacctggggccaccccgccttcccctcctgcgggaggctcaaggaggacagcaggtacatcttcttcatggagcccgacgccaacagcaccagccgcgcgccggccgccttccgagcctctttcccccctctggagacgggccggaacctcaagaaggaggtcagccgggtgctgtgcaagcggtgcgccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggaaaaaaaaaaaaaa

SEQ ID NO: 65 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPQLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 66 - protein, 422 aa, Homo sapiens; identical to SEQ ID NO: 65

SEQ ID NO: 67 - protein, 69 aa, Homo sapiens
MSERKEGRGKGKGKKKERGSGKKPESAAGSQSPREIITGMPASTEGAYVSSESPIRISVSTEGANTSSS

SEQ ID NO: 68 - protein, 19 aa, Bos taurus
RKGDVPGPRVKSSRSTTTA

SEQ ID NO: 69 - protein, 422 aa, Homo sapiens; identical to SEQ ID NO: 65

SEQ ID NO: 70 - DNA, 417 bp, Bos taurus
tctaaaactacagagactgtattttcatgatcatcatagttctgtgaaatatacttaaaccgctttggtcctgatcttgtaggaagtcagaacttcgcattagcaaagcgtcactggctgattctggagaatatatgtgcaaagtgatcagcaaactaggaaatgacagtgcctctgccaacatcaccattgtggagtcaaacggtaagagatgcctactgcgtgctatttctcagtctctaagaggagtgatcaaggtatgtggtcacacttgaatcacgcaggtgtgtgaaatctcattgtgaacaaataaaaatcatgaaaggaaaactctatgtttgaaatatcttatgggtcctcctgtaaagctcttcactccataaggtgaaatagacctgaaatatatatagattattt

SEQ ID NO: 71 - protein, 13 aa, Bos taurus
NYRDCIFMIIIVL

SEQ ID NO: 72 - DNA, 36 bp, Homo sapiens; identical to SEQ ID NO: 32

SEQ ID NO: 73 - protein, 42 aa, Bos taurus; identical to SEQ ID NO: 24

SEQ ID NO: 74 - protein, 23 aa, Bos taurus
KCQPGFTGARCTENVPMKVQTQE

SEQ ID NO: 75 - protein, 20 aa, Homo sapiens
KCPNEFTGDRCQNYVMASFY

SEQ ID NO: 76 - protein, 206 aa, Bos taurus; identical to SEQ ID NO: 2

SEQ ID NO: 77 - protein, 263 aa, Bos taurus
HQVWAAKAGGLKKDSLLTVRLGAWGHPAFPSCGRLKEDSRYIFFMEPEAKSSGGPGRLPSLLPPSRDGPEPQEGGQPGAVQRCALPPRLKEMKSQESVAGSKLVLRCETSSEYSSLKFKWFKNGSELSRKNKGGNIKIQKRPGKSELRISKASLADSGEYMCKVISKLGNDSASANITIVESNATSTSTAGTSHLVKSAEKEKTFCVNGGECFMVKDLSNPSRYLCKCQPGFTGARCTENVPMKVQTQESAQMSLLVIAAKTT

SEQ ID NO: 78 - protein, 257 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPPKSELRISKASLADSGEYMCKVISKLGNDSASANIRIVESNATSTSTAGTSHLVKCAEKEKTFCVNGGECFMVKDLSNPSRYLCKCPNEFTGDRCQNYVMASFYSTSTPFLSLPE

SEQ ID NO: 79 - protein, 34 aa, Bos taurus
MSERREGKGKGKGGKKDRGSGKKPVPAAGGPSPA

SEQ ID NO: 80 - protein, 83 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRC

SEQ ID NO: 81 - protein, 59 aa, Bos Taurus
LPPRLKEHKSQESVAGSKLVLRCETSSEYSSLKFKWFKNGSELSRKNKPGNIKIQKRPG

SEQ ID NO: 82 - protein, 41 aa, Bos taurus
KSELRISKASLADSGEYMCKVISKLGNDSASANITIVESNA

SEQ ID NO: 83 - protein, 63 aa, Bos Taurus; identical to SEQ ID NO: 19

SEQ ID NO: 84 - protein, 35 aa, Bos taurus
EITTGMPASTETAYVSSESPIRISVSTEGTNTSSS

SEQ ID NO: 85 - protein, 42 aa, Bos Taurus; identical to SEQ ID NO: 24

SEQ ID NO: 86 - protein, 23 aa, Bos taurus
KCQPGFTGARCTENVPMKVQTQE

SEQ ID NO: 87 - protein, 20 aa, Bos taurus
KCPNEFTGDRCQNYVMASFY

SEQ ID NO: 88 - protein, 11 aa, Bos taurus
STSTPFLSLPE

SEQ ID NO: 89 - protein, 9 aa, Bos taurus
KHLGIEFME

SEQ ID NO: 90 - protein, 188 aa, Bos taurus; identical to SEQ ID NO: 37

SEQ ID NO: 91 - protein, 47 aa, Bos taurus
HNLIAELRRNKAHRSKCMQIQLSATHLRASSIPHWASFSKTPWPLGR

SEQ ID NO: 92 - protein, 217 aa, Bos taurus; identical to SEQ ID NO: 42

SEQ ID NO: 93 - protein, 248 aa, Homo sapiens; identical to SEQ ID NO: 45

SEQ ID NO: 94 - protein, 241 aa, Bos taurus
MSERREGKGKGKGGKKDRGSGKKPVPAAGGPSPALPPRLKEMKSQESVAGSKLVLRCETSSEYSSLKFKWFKNGSELSRKNKPQNIKIQKRPGKSELRISKASLADSGEYMCKVISKLGNDSASANITIVESNEITTGMPASTETAYVSSESPIRISVSTEGTNTSSSTSTSTAGTSHLVKCAEKEKTFCVNGGECFMVKDLSNPSRYLCKCPNEFTGDRCQNYVMASFYSTSTPFLSLPE

SEQ ID NO: 95 - protein, 280 aa, Bos taurus
HQVWAAKAGGLKKDSLLTVRLGAWGHPAFPSCGRLKEDSRYIFFMEPEANSSGGPGRLPSLLPPSRDGPEPQEGGQPGAVQRCALPPRLKEMKSQESVAGSKLVLRCETSSEYSSLKFKWFKNGSELSRKNKPENIKIQKRPGKSELRISKASLADSGEYMCKVISKLGNDSASANITIVESNATSTSTAGTSHLVKCAEKEKTFCVNGGECFMVKDLSNPSRYLCKCQPGFTGARCTENVPMKVQTQEKCPNEFTGDRCQNYVMASFYSTSTPFLSLPE

SEQ ID NO: 96 - protein, 560 aa, Bos taurus
KSELRISKASLADSGEYMCKVISKLGNDSASANITIVESNATSTSTAGTSHLVKCAEKEKTFCVNGGDCFMVKDLSNPSRYLCKCQPGFTGARCTENVPMKVQTQEKAEELYQKRVLTITGICIALLVVGIMCVVVYCKTKKQRKKLHDRLRQSLRSERNTMMNVANGPHHPNPPPENVQLVNQYVSKNVISSEHIVEREAESSFSTSHYTSTAHHSTTVTQTPSHSWSNGHTESIISESHSVIVMSSVENSRHSSPTGGPRGRLNGLGGPRGCNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVASRTNPTGGFSPQEELQARLSGVIANQDPIAV

SEQ ID NO: 97 - protein, 65 aa, Homo sapiens; identical to SEQ ID NO: 53

SEQ ID NO: 98 - protein, 63 aa, Bos taurus; identical to SEQ ID NO: 55

SEQ ID NO: 99 - protein, 60 aa, Homo sapiens; identical to SEQ ID NO: 57

SEQ ID NO: 100 - protein, 69 aa, Homo sapiens; identical to SEQ ID NO: 59

SEQ ID NO: 101 - protein, 88 aa, Bos taurus; identical to SEQ ID NO: 61

SEQ ID NO: 102 - protein, 83 aa, Bos taurus; identical to SEQ ID NO: 63

SEQ ID NO: 103 - protein, 422 aa, Homo sapiens; identical to SEQ ID NO: 65

SEQ ID NO: 104 - protein, 13 aa, Bos taurus
NYRDCIFMIIIVL

SEQ ID NO: 105 - protein, 13 aa, Bos taurus
NYRDCIFMIIIVL

SEQ ID NO: 106 - protein, 9 aa, Bos taurus
  VARIANT 1: Xaa is unknown
XNILKPLWS

SEQ ID NO: 107 - protein, 67 aa, Bos taurus
  VARIANT 1: Xaa is unknown
XSCRKSELRISKASLADSGESMCKVISKLGNDSASANIRIVESNGKRCLLRAISQSLRGVIKVCGHT

SEQ ID NO: 108 - protein, 10 aa, Bos taurus
  VARIANT 1: Xaa is unknown
XITQVCEISC

SEQ ID NO: 109 - protein, 26 aa, Bos taurus
  VARIANT 1: Xaa is unknown
XTNKNHERKTLCLKYLMGPPVKLFTP

SEQ ID NO: 110 - protein, 9 aa, Bos taurus
  VARIANT 1: Xaa is unknown
XGEIDLKYI

SEQ ID NO: 111 - protein, 3 aa, Bos taurus
  VARIANT 1: Xaa is unknown
XII

SEQ ID NO: 112 - protein, 11 aa, Bos taurus
VCLLTVAALPP

SEQ ID NO: 113 - protein, 15 aa, Bos taurus
ASPVSVGSVQELVQR

SEQ ID NO: 114 - protein, 8 aa, Bos taurus
WFVVIEGK

SEQ ID NO: 115 - protein, 9 aa, Bos taurus
KVHEVWAAK

SEQ ID NO: 116 - protein, 6 aa, Bos Taurus
  VARIANT 5: Xaa is unknown
DLLLXV

SEQ ID NO: 117 - protein, 13 aa, Bos taurus
  VARIANT 12: Xaa is unknown
LGAWGPPAFPVXY

SEQ ID NO: 118 - protein, 13 aa, Bos taurus
  VARIANT 10: Xaa is unknown
YIFFMEPEAXSSG

SEQ ID NO: 119 - protein, 4 aa, Bos taurus
LVLR

SEQ ID NO: 120 - protein, 13 aa, Bos taurus
  VARIANT 12: Xaa is Cys
KASLADSGEYMXK

SEQ ID NO: 121 - protein, 100 aa, Homo sapiens
LPPQLKEMKSQESAAGSKLVLRCETSSEYSSLRFKWFKNGNELNRKNKPQNIKIQKRPGKSELRISKASLADSGEYMCKVISKLGNDSASANITIVESNA

SEQ ID NO: 122 - DNA, 197 bp, Homo sapiens
  CDS (3)...(197)
ctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaa

SEQ ID NO: 123 - DNA, 188 bp, Homo sapiens
  CDS (3)...(188)
ctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctac

SEQ ID NO: 124 - DNA, 197 bp, Bos taurus
  CDS (3)...(197)
ccacatccacatctacagctgggacaagccatcttgtcaagtgtgcagagaaggagaaaactttctgtgtgaatggaggcgagtgcttcatggtgaaagacctttcaaatccctcaagatacttgtgcaagtgccaacctggattcactggagcgagatgtactgagaatgtgcccatgaaagtccaaacccaagaa

SEQ ID NO: 125 - DNA, 188 bp, Bos taurus
ccacatccacatctacagctgggacaagccatcttgtcaagtgtgcagagaaggagaaaactttctgtgtgaatggaggcgagtgcttcatggtgaaagacctttcaaatccctcaagatacttgtgcaagtgcccaaatgagtttactggtgatcgctgccaaaactacgtaatggccagcttctac

SEQ ID NO: 126 - protein, 8 aa, Bos taurus
NILKPLWS

SEQ ID NO: 127 - protein, 66 aa, Bos taurus
SCRKSELRISKASLADSGESMCKVISKLGNDSASANIRIVESNGKRCLLRAISQSLRGVIKVCGHT

SEQ ID NO: 128 - protein, 9 aa, Bos taurus
ITQVCEISC

SEQ ID NO: 129 - protein, 25 aa, Bos taurus
TNKNHERKTLCLKYLMGPPVKLFTP

SEQ ID NO: 130 - protein, 8 aa, Bos taurus
GEIDLKYI

SEQ ID NO: 131 - protein, 8 aa, Bos taurus
NILKPLWS

SEQ ID NO: 132 - protein, 66 aa, Bos Taurus; identical to SEQ ID NO: 127

SEQ ID NO: 133 - protein, 9 aa, Bos taurus
ITQVCEISC

SEQ ID NO: 134 - protein, 25 aa, Bos taurus
TNKNHERKTLCLKYLMGPPVKLFTP

SEQ ID NO: 135 - protein, 8 aa, Bos taurus
GEIDLKYI

SEQ ID NO: 136 - protein, 65 aa, Bos taurus
TSTSTAGTSHLVKCAEKEKTFCVNGGECFMVKDLSNPSRYLCKCQPGFTGARCTENVPMKVQTQE

SEQ ID NO: 137 - protein, 62 aa, Bos taurus
TSTSTAGTSHLVKCAEKEKTFCVNGGECFMVKDLSNPSRYLCKCPNEFTGDRCQNYVMASFY

SEQ ID NO: 138 - protein, 653 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 139 - protein, 389 aa, Homo sapiens
  VARIANT 389: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 140 - protein, 606 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 141 - protein, 210 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 142 - protein, 603 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 143 - protein, 650 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 144 - protein, 386 aa, Homo sapiens
  VARIANT 386: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 145 - protein, 207 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 146 - protein, 673 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 147 - protein, 409 aa, Homo sapiens
  VARIANT 409: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 148 - protein, 626 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 149 - protein, 230 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 150 - protein, 398 aa, Homo sapiens
  VARIANT 398: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 151 - protein, 615 aa, homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 152 - protein, 662 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 153 - protein, 395 aa, Homo sapiens
  VARIANT 395: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 154 - protein, 612 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 155 - protein, 659 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 156 - protein, 418 aa, Homo Sapiens
  VARIANT 418: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 157 - protein, 635 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 158 - protein, 682 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 159 - protein, 619 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 160 - protein, 355 aa, Homo sapiens
  VARIANT 355: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 161 - protein, 572 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 162 - protein, 176 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 163 - protein, 569 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 164 - protein, 616 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 165 - protein, 352 aa, Homo sapiens
  VARIANT 352: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 166 - protein, 173 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 167 - protein, 639 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 168 - protein, 375 aa, Homo sapiens
  VARIANT 375: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 169 - protein, 592 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 170 - protein, 196 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 171 - protein, 364 aa, Homo sapiens
  VARIANT 364: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 172 - protein, 581 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 173 - protein, 628 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 174 - protein, 361 aa, Homo sapiens
  VARIANT 361: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 175 - protein, 578 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 176 - protein, 625 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 177 - protein, 384 aa, Homo sapiens
  VARIANT 384: Xaa is Arg or is absent
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 178 - protein, 601 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 179 - protein, 648 aa, Homo sapiens
LPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 180 - protein, 687 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 181 - protein, 423 aa, Homo sapiens
  VARIANT 423: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 182 - protein, 640 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 183 - protein, 244 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 184 - protein, 637 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 185 - protein, 684 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 186 - protein, 420 aa, Homo sapiens
  VARIANT 420: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 187 - protein, 241 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 188 - protein, 707 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 189 - protein, 443 aa, Homo sapiens
  VARIANT 443: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 190 - protein, 660 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 191 - protein, 264 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 192 - protein, 432 aa, Homo sapiens
  VARIANT 432: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 193 - protein, 649 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 194 - protein, 696 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 195 - protein, 429 aa, Homo sapiens
  VARIANT 429: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 196 - protein, 646 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 197 - protein, 693 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 198 - protein, 452 aa, Homo sapiens
  VARIANT 452: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 199 - protein, 669 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 200 - protein, 716 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 201 - protein, 653 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 202 - protein, 389 aa, Homo sapiens
  VARIANT 389: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 203 - protein, 606 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 204 - protein, 210 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 205 - protein, 603 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 206 - protein, 650 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 207 - protein, 386 aa, Homo sapiens
  VARIANT 386: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 208 - protein, 207 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 209 - protein, 673 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 210 - protein, 409 aa, Homo sapiens
  VARIANT 409: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 211 - protein, 626 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 212 - protein, 230 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 213 - protein, 398 aa, Homo sapiens
  VARIANT 398: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 214 - protein, 615 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 215 - protein, 662 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 216 - protein, 395 aa, Homo sapiens
  VARIANT 395: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 217 - protein, 612 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 218 - protein, 659 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 219 - protein, 418 aa, Homo sapiens
  VARIANT 418: Xaa is Arg or is absent
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 220 - protein, 635 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 221 - protein, 682 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 222 - protein, 902 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 223 - protein, 638 aa, Homo sapiens
  VARIANT 638: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 224 - protein, 855 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 225 - protein, 459 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 226 - protein, 852 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 227 - protein, 899 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 228 - protein, 635 aa, Homo sapiens
  VARIANT 635: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 229 - protein, 456 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 230 - protein, 922 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 231 - protein, 658 aa, Homo sapiens
  VARIANT 658: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 232 - protein, 875 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 233 - protein, 479 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 234 - protein, 647 aa, Homo sapiens
  VARIANT 647: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 235 - protein, 864 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 236 - protein, 911 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 237 - protein, 644 aa, Homo sapiens
  VARIANT 644: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 238 - protein, 861 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 239 - protein, 908 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 240 - protein, 667 aa, Homo sapiens
  VARIANT 667: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 241 - protein, 884 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 242 - protein, 931 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 243 - protein, 868 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 244 - protein, 604 aa, Homo sapiens
  VARIANT 604: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 245 - protein, 821 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 246 - protein, 425 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 247 - protein, 818 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 248 - protein, 865 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 249 - protein, 601 aa, Homo sapiens
  VARIANT 601: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 250 - protein, 422 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 251 - protein, 888 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 252 - protein, 624 aa, Homo sapiens
  VARIANT 624: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 253 - protein, 841 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 254 - protein, 445 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 255 - protein, 613 aa, Homo sapiens
  VARIANT 613: Xaa is Arg
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 256 - protein, 830 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 257 - protein, 877 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 258 - protein, 610 aa, Homo sapiens
  VARIANT 610: Xaa is Arg or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 259 - protein, 827 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 260 - protein, 874 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 261 - protein, 633 aa, Homo sapiens
  VARIANT 633: Xaa is any amino acid or is absent
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 262 - protein, 850 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 263 - protein, 897 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 264 - protein, 936 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 265 - protein, 672 aa, Homo sapiens
  VARIANT 34: Xaa is any amino acid or is absent
  VARIANT 672: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 266 - protein, 889 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 267 - protein, 493 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESTSTPFLSLPE

SEQ ID NO: 268 - protein, 886 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 269 - protein, 933 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 270 - protein, 669 aa, Homo sapiens
  VARIANT 34: Xaa is any amino acid or is absent
  VARIANT 669: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 271 - protein, 490 aa, Homo sapiens
  VARIANT 34: Xaa
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 272 - protein, 956 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 273 - protein, 692 aa, Homo sapiens
  VARIANT 34: Xaa is any amino acid or is absent
  VARIANT 692: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 274 - protein, 909 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 275 - protein, 513 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 276 - protein, 681 aa, Homo sapiens
  VARIANT 34: Xaa is any amino acid or is absent
  VARIANT 681: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 277 - protein, 898 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 278 - protein, 945 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 279 - protein, 678 aa, Homo sapiens
  VARIANT 34: Xaa is any amino acid or is absent
  VARIANT 678: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 280 - protein, 895 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 281 - protein, 942 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 282 - protein, 701 aa, Homo sapiens
  VARIANT 34: Xaa is any amino acid or is absent
  VARIANT 701: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 283 - protein, 918 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 284 - protein, 965 aa, Hono sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 285 - protein, 902 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 286 - protein, 638 aa, Homo sapiens
  VARIANT 34: Xaa is any amino acid or is absent
  VARIANT 638: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 287 - protein, 855 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 288 - protein, 459 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQESTSTPFLSLPE

SEQ ID NO: 289 - protein, 852 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 290 - protein, 899 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 291 - protein, 635 aa, Homo sapiens
  VARIANT 34: Xaa is Arg or is absent
  VARIANT 635: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 292 - protein, 456 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 293 - protein, 922 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 294 - protein, 658 aa, Homo sapiens
  VARIANT 34: Xaa is any amino acid or is absent
  VARIANT 658: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 295 - protein, 875 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 296 - protein, 479 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYSTSTPFLSLPE

SEQ ID NO: 297 - protein, 647 aa, Homo sapiens
  VARIANT 34: Xaa is any amino acid or is absent
  VARIANT 647: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 298 - protein, 864 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 299 - protein, 911 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 300 - protein, 644 aa, Homo sapiens
  VARIANT 34: Xaa is any amino acid or is absent
  VARIANT 644: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 301 - protein, 861 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 302 - protein, 908 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 303 - protein, 667 aa, Homo sapiens
  VARIANT 34: Xaa is any amino acid
  VARIANT 667: Xaa is Arg or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 304 - protein, 884 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 305 - protein, 931 aa, Homo sapiens
  VARIANT 34: Xaa is any amino acid or is absent
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 306 - protein, 156 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRISKASLADSGEYMCKVISKLGNDSASANITIVESNGKRCLLRAISQSLRGVIKVCGHT

SEQ ID NO: 307 - protein, 405 aa, Homo sapiens
  VARIANT 34: Xaa is Ala
MSERKEGRGKGKGKKKERGSGKKPESAAGSQSPXMRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRISKASLADSGEYMCKVISKLGNDSASANITIVESNGKRCLLRAISQSLRGVIKVCGHT

SEQ ID NO: 308 - protein, 371 aa, Homo sapiens
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRISKASLADSGEYMCKVISKLGNDSASANITIVESNGKRCLLRAISQSLRGVIKVCGHT

SEQ ID NO: 309 - protein, 477 aa, Homo sapiens
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 310 - protein, 213 aa, Homo sapiens
  VARIANT 213: Xaa is Arg or is absent
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 311 - protein, 430 aa, Homo sapiens
KCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 312 - protein, 34 aa, Homo sapiens
KCQPGFTGARCTENVPMKVQNQESTSTPFLSLPE

SEQ ID NO: 313 - protein, 427 aa, Homo sapiens
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 314 - protein, 474 aa, Homo sapiens
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 315 - protein, 210 aa, Homo sapiens
  VARIANT 210: Xaa is Arg or is absent
KCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 316 - protein, 31 aa, Homo sapiens
KCPNEFTGDRCQNYVMASFYSTSTPFLSLPE

SEQ ID NO: 317 - protein, 497 aa, Homo sapiens
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 318 - protein, 233 aa, Homo sapiens
  VARIANT 233: Xaa is Arg or is absent
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 319 - protein, 450 aa, Homo sapiens
KCQPGFTGARCTENVPMKVQNQEKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 320 - protein, 54 aa, Homo sapiens
KCQPGFTGARCTENVPMKVQNQEKCPNEFTGDRCQNYVMASFYSTSTPFLSLPE

SEQ ID NO: 321 - protein, 222 aa, Homo sapiens
  VARIANT 222: Xaa is Arg or is absent
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 322 - protein, 439 aa, Homo sapiens
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 323 - protein, 486 aa, Homo sapiens
KCQPGFTGARCTENVPMKVQNQEKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 324 - protein, 219 aa, Homo sapiens
  VARIANT 219: Xaa is Arg or is absent
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 325 - protein, 436 aa, Homo sapiens
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 326 - protein, 483 aa, Homo sapiens
KCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 327 - protein, 242 aa, Homo sapiens
  VARIANT 242: Xaa is Arg or is Absent
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSEX

SEQ ID NO: 328 - protein, 459 aa, Homo sapiens
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 329 - protein, 506 aa, Homo sapiens
KCQPGFTGARCTENVPMKVQNQEKCPNEFTGDRCQNYVMASFYKHLGIEFMEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRASSIPHWASFSKTPWPLGRYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

What is claimed is:

1. A method for the treatment of a pathophysiological condition of retinal cells of a mammal, wherein said pathophysiological condition is selected from the group consisting of a retinopathy, hypertensive retinopathy, diabetic retinopathy, occlusive retinopathy, retinal degeneration, retinal degeneration caused by injury, retinal degeneration caused by a genetic disorder, retinal degeneration by retinitis pigmentosa, and retinal degeneration caused by age related macular degeneration, or is caused by elevated intraocular pressure or an optic neuropathy, or involves retinal cell damage, said method comprising administering to said mammal a therapeutically effective amount of human glial growth factor 2 polypeptide (SEQ. ID. NO.: 65).

2. The method of claim 1, wherein said treatment of the pathophysiological condition of retinal cells results in decreasing the atrophy of said retinal cells.

3. The method of claim 1, wherein said treatment of the pathophysiological condition of retinal cells results in increasing the retinal cells present in said mammal.

4. The method of claim 1, wherein said treatment of the pathophysiological condition of retinal cells results in increasing the retinal cells survival in said mammal.

5. The method of claim 1, wherein said pathophysiological condition of retinal cells is a retinopathy.

6. The method of claim 1, wherein said pathophysiological condition of retinal cells is hypertensive retinopathy.

7. The method of claim 1, wherein said pathophysiological condition of retinal cells is diabetic retinopathy.

8. The method of claim 1, wherein said pathophysiological condition of retinal cells is occlusive retinopathy.

9. The method of claim 1, wherein said pathophysiological condition of retinal cells is retinal degeneration.

10. The method of claim 1, wherein said pathophysiological condition of retinal cells is retinal degeneration caused by injury.

11. The method of claim 1, wherein said pathophysiological condition of retinal cells is retinal degeneration caused by a genetic disorder.

12. The method of claim 1, wherein said pathophysiological condition of retinal cells is retinal degeneration by retinis pigmentosa.

13. The method of claim 1, wherein said pathophysiological condition of retinal cells is retinal degeneration caused by age related macular degeneration.

14. The method of claim 1, wherein said pathophysiological condition of retinal cells is caused by an optic neuropathy.

15. The method as claimed in claim 1, wherein said pathophysiological condition involves retinal cell damage.

16. The method of claim 1, wherein said retinal cell type is a retinal ganglion cell.

17. The method of claim 1, wherein said retinal cell type is an amacrine cell.

18. The method of claim 1, wherein said retinal cell type is a horizontal cell.

19. The method of claim 1, wherein said retinal cell type is a bipolar cell.

20. The method of claim 1, wherein said retinal cell type is a photoreceptor cell.

21. The method of claim 1, wherein said retinal cells type is a pigment cell.

* * * * *